United States Patent 12,570,711 (PLATFORMS FOR CO-STIMULATION, NOVEL CAR DESIGNS AND OTHER ENHANCEMENTS FOR ADOPTIVE CELLULAR THERAPY) - sequence listing, part 8

SEQ ID NO: 12786 - protein, 1236 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVGGGGSGGGGSGGGGSQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12787 - protein, 1075 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12788 - protein, 1400 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12789 - protein, 1067 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12790 - protein, 670 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVGGGGSGGGGSGGGGSQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12791 - protein, 651 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12792 - protein, 621 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12793 - protein, 703 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12794 - protein, 719 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVGGGGSGGGGSGGGGSQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12795 - protein, 658 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12796 - protein, 507 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12797 - protein, 507 aa, Artificial Sequence
  Synthetic Polypeptide encoding a CAR and optional  accessory module(s)
MALPVTALLLPLALLLHAARPEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSGGGGSGGGGSGGGGSDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12798 - protein, 683 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12799 - protein, 914 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12800 - protein, 902 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12801 - protein, 867 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12802 - protein, 877 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12803 - protein, 860 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12804 - protein, 852 aa, Artificial Sequence
  Synthetic Polypeptide encoding a CAR and optional  accessory module(s)
MALPVTALLLPLALLLHAARPEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSGGGGSGGGGSGGGGSDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12805 - protein, 867 aa, Artificial Sequence
  Synthetic Polypeptide encoding a CAR and optional  accessory module(s)
MALPVTALLLPLALLLHAARPEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSGGGGSGGGGSGGGGSDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12806 - protein, 877 aa, Artificial Sequence
  Synthetic Polypeptide encoding a CAR and optional  accessory module(s)
MALPVTALLLPLALLLHAARPEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSGGGGSGGGGSGGGGSDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12807 - protein, 860 aa, Artificial Sequence
  Synthetic Polypeptide encoding a CAR and optional  accessory module(s)
MALPVTALLLPLALLLHAARPEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSGGGGSGGGGSGGGGSDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12808 - protein, 626 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12809 - protein, 630 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12810 - protein, 641 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12811 - protein, 640 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12812 - protein, 636 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12813 - protein, 657 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12814 - protein, 1079 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12815 - protein, 1080 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12816 - protein, 1133 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12817 - protein, 1083 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12818 - protein, 1079 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12819 - protein, 897 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12820 - protein, 1241 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12821 - protein, 1080 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12822 - protein, 1405 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12823 - protein, 1072 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12824 - protein, 675 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12825 - protein, 656 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12826 - protein, 626 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12827 - protein, 708 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12828 - protein, 724 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12829 - protein, 663 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12830 - protein, 507 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12831 - protein, 507 aa, Artificial Sequence
  Synthetic Polypeptide encoding a CAR and optional  accessory module(s)
MALPVTALLLPLALLLHAARPQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSGGGGSGGGGSGGGGSDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12832 - protein, 683 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12833 - protein, 914 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12834 - protein, 902 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12835 - protein, 867 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12836 - protein, 877 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12837 - protein, 860 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12838 - protein, 852 aa, Artificial Sequence
  Synthetic Polypeptide encoding a CAR and optional  accessory module(s)
MALPVTALLLPLALLLHAARPQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSGGGGSGGGGSGGGGSDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12839 - protein, 867 aa, Artificial Sequence
  Synthetic Polypeptide encoding a CAR and optional  accessory module(s)
MALPVTALLLPLALLLHAARPQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSGGGGSGGGGSGGGGSDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12840 - protein, 877 aa, Artificial Sequence
  Synthetic Polypeptide encoding a CAR and optional  accessory module(s)
MALPVTALLLPLALLLHAARPQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSGGGGSGGGGSGGGGSDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12841 - protein, 860 aa, Artificial Sequence
  Synthetic Polypeptide encoding a CAR and optional  accessory module(s)
MALPVTALLLPLALLLHAARPQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSGGGGSGGGGSGGGGSDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12842 - protein, 626 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12843 - protein, 630 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12844 - protein, 641 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12845 - protein, 640 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12846 - protein, 636 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12847 - protein, 657 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12848 - protein, 1079 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12849 - protein, 1080 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12850 - protein, 1133 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12851 - protein, 1083 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12852 - protein, 1079 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12853 - protein, 897 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12854 - protein, 1241 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12855 - protein, 1080 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12856 - protein, 1405 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12857 - protein, 1072 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12858 - protein, 675 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12859 - protein, 656 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12860 - protein, 626 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12861 - protein, 708 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12862 - protein, 724 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12863 - protein, 663 aa, Artificial Sequence
  Synthetic Polypeptide encoding a CAR and optional  accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12864 - protein, 504 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12865 - protein, 504 aa, Artificial Sequence
  Synthetic Polypeptide encoding a CAR and optional  accessory module(s)
MALPVTALLLPLALLLHAARPEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSGGGGSGGGGSGGGGSDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12866 - protein, 680 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12867 - protein, 911 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12868 - protein, 899 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12869 - protein, 864 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12870 - protein, 874 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12871 - protein, 857 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12872 - protein, 849 aa, Artificial Sequence
  Synthetic Polypeptide encoding a CAR and optional  accessory module(s)
MALPVTALLLPLALLLHAARPEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSGGGGSGGGGSGGGGSDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12873 - protein, 864 aa, Artificial Sequence
  Synthetic Polypeptide encoding a CAR and optional  accessory module(s)
MALPVTALLLPLALLLHAARPEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSGGGGSGGGGSGGGGSDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12874 - protein, 874 aa, Artificial Sequence
  Synthetic Polypeptide encoding a CAR and optional  accessory module(s)
MALPVTALLLPLALLLHAARPEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSGGGGSGGGGSGGGGSDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12875 - protein, 857 aa, Artificial Sequence
  Synthetic Polypeptide encoding a CAR and optional  accessory module(s)
MALPVTALLLPLALLLHAARPEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSGGGGSGGGGSGGGGSDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12876 - protein, 623 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12877 - protein, 627 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12878 - protein, 638 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12879 - protein, 637 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12880 - protein, 633 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12881 - protein, 654 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12882 - protein, 1076 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12883 - protein, 1077 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12884 - protein, 1130 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12885 - protein, 1080 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12886 - protein, 1076 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12887 - protein, 894 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12888 - protein, 1238 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12889 - protein, 1077 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12890 - protein, 1402 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12891 - protein, 1069 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12892 - protein, 672 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12893 - protein, 653 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12894 - protein, 623 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12895 - protein, 705 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12896 - protein, 721 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12897 - protein, 660 aa, Artificial Sequence
  Synthetic Polypeptide encoding a CAR and optional  accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12898 - protein, 502 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12899 - protein, 502 aa, Artificial Sequence
  Synthetic Polypeptide encoding a CAR and optional  accessory module(s)
MALPVTALLLPLALLLHAARPEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSGGGGSGGGGSGGGGSDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12900 - protein, 678 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12901 - protein, 909 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12902 - protein, 897 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12903 - protein, 862 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12904 - protein, 872 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12905 - protein, 855 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12906 - protein, 847 aa, Artificial Sequence
  Synthetic Polypeptide encoding a CAR and optional  accessory module(s)
MALPVTALLLPLALLLHAARPEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSGGGGSGGGGSGGGGSDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12907 - protein, 862 aa, Artificial Sequence
  Synthetic Polypeptide encoding a CAR and optional  accessory module(s)
MALPVTALLLPLALLLHAARPEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSGGGGSGGGGSGGGGSDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12908 - protein, 872 aa, Artificial Sequence
  Synthetic Polypeptide encoding a CAR and optional  accessory module(s)
MALPVTALLLPLALLLHAARPEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSGGGGSGGGGSGGGGSDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12909 - protein, 855 aa, Artificial Sequence
  Synthetic Polypeptide encoding a CAR and optional  accessory module(s)
MALPVTALLLPLALLLHAARPEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSGGGGSGGGGSGGGGSDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12910 - protein, 621 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12911 - protein, 625 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12912 - protein, 636 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12913 - protein, 635 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12914 - protein, 631 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12915 - protein, 652 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12916 - protein, 1074 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12917 - protein, 1075 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12918 - protein, 1128 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12919 - protein, 1078 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12920 - protein, 1074 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12921 - protein, 892 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12922 - protein, 1236 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12923 - protein, 1075 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12924 - protein, 1400 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12925 - protein, 1067 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12926 - protein, 670 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12927 - protein, 651 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12928 - protein, 621 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12929 - protein, 703 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12930 - protein, 719 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12931 - protein, 658 aa, Artificial Sequence
  Synthetic Polypeptide encoding a CAR and optional  accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12932 - protein, 504 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKGGGGSGGGGSGGGGSGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12933 - protein, 504 aa, Artificial Sequence
  Synthetic Polypeptide encoding a CAR and optional  accessory module(s)
MALPVTALLLPLALLLHAARPGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTGGGGSGGGGSGGGGSDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12934 - protein, 680 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKGGGGSGGGGSGGGGSGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12935 - protein, 911 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKGGGGSGGGGSGGGGSGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12936 - protein, 899 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKGGGGSGGGGSGGGGSGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12937 - protein, 864 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKGGGGSGGGGSGGGGSGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12938 - protein, 874 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKGGGGSGGGGSGGGGSGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12939 - protein, 857 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKGGGGSGGGGSGGGGSGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12940 - protein, 849 aa, Artificial Sequence
  Synthetic Polypeptide encoding a CAR and optional  accessory module(s)
MALPVTALLLPLALLLHAARPGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTGGGGSGGGGSGGGGSDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12941 - protein, 864 aa, Artificial Sequence
  Synthetic Polypeptide encoding a CAR and optional  accessory module(s)
MALPVTALLLPLALLLHAARPGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTGGGGSGGGGSGGGGSDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12942 - protein, 874 aa, Artificial Sequence
  Synthetic Polypeptide encoding a CAR and optional  accessory module(s)
MALPVTALLLPLALLLHAARPGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTGGGGSGGGGSGGGGSDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12943 - protein, 857 aa, Artificial Sequence
  Synthetic Polypeptide encoding a CAR and optional  accessory module(s)
MALPVTALLLPLALLLHAARPGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTGGGGSGGGGSGGGGSDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12944 - protein, 623 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12945 - protein, 627 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12946 - protein, 638 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12947 - protein, 637 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12948 - protein, 633 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12949 - protein, 654 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12950 - protein, 1076 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12951 - protein, 1077 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12952 - protein, 1130 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12953 - protein, 1080 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12954 - protein, 1076 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12955 - protein, 894 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKGGGGSGGGGSGGGGSGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12956 - protein, 1238 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKGGGGSGGGGSGGGGSGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12957 - protein, 1077 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12958 - protein, 1402 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12959 - protein, 1069 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12960 - protein, 672 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKGGGGSGGGGSGGGGSGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12961 - protein, 653 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12962 - protein, 623 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12963 - protein, 705 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12964 - protein, 721 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKGGGGSGGGGSGGGGSGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12965 - protein, 660 aa, Artificial Sequence
  Synthetic Polypeptide encoding a CAR and optional  accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12966 - protein, 510 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGGGGGSGGGGSGGGGSQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12967 - protein, 510 aa, Artificial Sequence
  Synthetic Polypeptide encoding a CAR and optional  accessory module(s)
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12968 - protein, 686 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGGGGGSGGGGSGGGGSQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12969 - protein, 917 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGGGGGSGGGGSGGGGSQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12970 - protein, 905 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGGGGGSGGGGSGGGGSQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12971 - protein, 870 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGGGGGSGGGGSGGGGSQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12972 - protein, 880 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGGGGGSGGGGSGGGGSQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12973 - protein, 863 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGGGGGSGGGGSGGGGSQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12974 - protein, 855 aa, Artificial Sequence
  Synthetic Polypeptide encoding a CAR and optional  accessory module(s)
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12975 - protein, 870 aa, Artificial Sequence
  Synthetic Polypeptide encoding a CAR and optional  accessory module(s)
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12976 - protein, 880 aa, Artificial Sequence
  Synthetic Polypeptide encoding a CAR and optional  accessory module(s)
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12977 - protein, 863 aa, Artificial Sequence
  Synthetic Polypeptide encoding a CAR and optional  accessory module(s)
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12978 - protein, 629 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12979 - protein, 633 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12980 - protein, 644 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12981 - protein, 643 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12982 - protein, 639 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12983 - protein, 660 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12984 - protein, 1082 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12985 - protein, 1083 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12986 - protein, 1136 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12987 - protein, 1086 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12988 - protein, 1082 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12989 - protein, 900 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGGGGGSGGGGSGGGGSQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12990 - protein, 1244 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGGGGGSGGGGSGGGGSQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12991 - protein, 1083 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12992 - protein, 1408 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12993 - protein, 1075 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12994 - protein, 678 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGGGGGSGGGGSGGGGSQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12995 - protein, 659 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12996 - protein, 629 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12997 - protein, 711 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12998 - protein, 727 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGGGGGSGGGGSGGGGSQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12999 - protein, 666 aa, Artificial Sequence
  Synthetic Polypeptide encoding a CAR and optional  accessory module(s)
MALPVTALLLPLALLLHAARPSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 13000 - protein, 499 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 13001 - protein, 499 aa, Artificial Sequence
  Synthetic Polypeptide encoding a CAR and optional  accessory module(s)
MALPVTALLLPLALLLHAARPQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSGGGGSGGGGSGGGGSDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 13002 - protein, 675 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 13003 - protein, 906 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13004 - protein, 894 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13005 - protein, 859 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13006 - protein, 869 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13007 - protein, 852 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13008 - protein, 844 aa, Artificial Sequence
  Synthetic Polypeptide encoding a CAR and optional  accessory module(s)
MALPVTALLLPLALLLHAARPQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSGGGGSGGGGSGGGGSDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 13009 - protein, 859 aa, Artificial Sequence
  Synthetic Polypeptide encoding a CAR and optional  accessory module(s)
MALPVTALLLPLALLLHAARPQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSGGGGSGGGGSGGGGSDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13010 - protein, 869 aa, Artificial Sequence
  Synthetic Polypeptide encoding a CAR and optional  accessory module(s)
MALPVTALLLPLALLLHAARPQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSGGGGSGGGGSGGGGSDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13011 - protein, 852 aa, Artificial Sequence
  Synthetic Polypeptide encoding a CAR and optional  accessory module(s)
MALPVTALLLPLALLLHAARPQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSGGGGSGGGGSGGGGSDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13012 - protein, 618 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13013 - protein, 622 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 13014 - protein, 633 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13015 - protein, 632 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13016 - protein, 628 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13017 - protein, 649 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13018 - protein, 1071 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13019 - protein, 1072 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13020 - protein, 1125 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 13021 - protein, 1075 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13022 - protein, 1071 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13023 - protein, 889 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13024 - protein, 1233 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 13025 - protein, 1072 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13026 - protein, 1397 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 13027 - protein, 1064 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13028 - protein, 667 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 13029 - protein, 648 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 13030 - protein, 618 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 13031 - protein, 700 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 13032 - protein, 716 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 13033 - protein, 655 aa, Artificial Sequence
  Synthetic Polypeptide encoding a CAR and optional  accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 13034 - protein, 498 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRGGGGSGGGGSGGGGSAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 13035 - protein, 498 aa, Artificial Sequence
  Synthetic Polypeptide encoding a CAR and optional  accessory module(s)
MALPVTALLLPLALLLHAARPAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSGGGGSGGGGSGGGGSDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 13036 - protein, 674 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRGGGGSGGGGSGGGGSAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 13037 - protein, 905 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRGGGGSGGGGSGGGGSAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13038 - protein, 893 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRGGGGSGGGGSGGGGSAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13039 - protein, 858 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRGGGGSGGGGSGGGGSAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13040 - protein, 868 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRGGGGSGGGGSGGGGSAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13041 - protein, 851 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRGGGGSGGGGSGGGGSAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13042 - protein, 843 aa, Artificial Sequence
  Synthetic Polypeptide encoding a CAR and optional  accessory module(s)
MALPVTALLLPLALLLHAARPAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSGGGGSGGGGSGGGGSDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 13043 - protein, 858 aa, Artificial Sequence
  Synthetic Polypeptide encoding a CAR and optional  accessory module(s)
MALPVTALLLPLALLLHAARPAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSGGGGSGGGGSGGGGSDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13044 - protein, 868 aa, Artificial Sequence
  Synthetic Polypeptide encoding a CAR and optional  accessory module(s)
MALPVTALLLPLALLLHAARPAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSGGGGSGGGGSGGGGSDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13045 - protein, 851 aa, Artificial Sequence
  Synthetic Polypeptide encoding a CAR and optional  accessory module(s)
MALPVTALLLPLALLLHAARPAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSGGGGSGGGGSGGGGSDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13046 - protein, 617 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13047 - protein, 621 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 13048 - protein, 632 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13049 - protein, 631 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13050 - protein, 627 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13051 - protein, 648 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13052 - protein, 1070 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13053 - protein, 1071 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13054 - protein, 1124 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 13055 - protein, 1074 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13056 - protein, 1070 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13057 - protein, 888 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRGGGGSGGGGSGGGGSAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13058 - protein, 1232 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRGGGGSGGGGSGGGGSAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 13059 - protein, 1071 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13060 - protein, 1396 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 13061 - protein, 1063 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13062 - protein, 666 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRGGGGSGGGGSGGGGSAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 13063 - protein, 647 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 13064 - protein, 617 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 13065 - protein, 699 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 13066 - protein, 715 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRGGGGSGGGGSGGGGSAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 13067 - protein, 654 aa, Artificial Sequence
  Synthetic Polypeptide encoding a CAR and optional  accessory module(s)
MALPVTALLLPLALLLHAARPDIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 13068 - protein, 499 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRGGGGSGGGGSGGGGSQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 13069 - protein, 499 aa, Artificial Sequence
  Synthetic Polypeptide encoding a CAR and optional  accessory module(s)
MALPVTALLLPLALLLHAARPQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSGGGGSGGGGSGGGGSDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 13070 - protein, 675 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRGGGGSGGGGSGGGGSQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 13071 - protein, 906 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRGGGGSGGGGSGGGGSQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13072 - protein, 894 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRGGGGSGGGGSGGGGSQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13073 - protein, 859 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRGGGGSGGGGSGGGGSQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13074 - protein, 869 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRGGGGSGGGGSGGGGSQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13075 - protein, 852 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRGGGGSGGGGSGGGGSQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13076 - protein, 844 aa, Artificial Sequence
  Synthetic Polypeptide encoding a CAR and optional  accessory module(s)
MALPVTALLLPLALLLHAARPQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSGGGGSGGGGSGGGGSDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 13077 - protein, 859 aa, Artificial Sequence
  Synthetic Polypeptide encoding a CAR and optional  accessory module(s)
MALPVTALLLPLALLLHAARPQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSGGGGSGGGGSGGGGSDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13078 - protein, 869 aa, Artificial Sequence
  Synthetic Polypeptide encoding a CAR and optional  accessory module(s)
MALPVTALLLPLALLLHAARPQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSGGGGSGGGGSGGGGSDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13079 - protein, 852 aa, Artificial Sequence
  Synthetic Polypeptide encoding a CAR and optional  accessory module(s)
MALPVTALLLPLALLLHAARPQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSGGGGSGGGGSGGGGSDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13080 - protein, 618 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13081 - protein, 622 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 13082 - protein, 633 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13083 - protein, 632 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13084 - protein, 628 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13085 - protein, 649 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13086 - protein, 1071 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13087 - protein, 1072 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13088 - protein, 1125 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 13089 - protein, 1075 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13090 - protein, 1071 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13091 - protein, 889 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRGGGGSGGGGSGGGGSQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13092 - protein, 1233 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRGGGGSGGGGSGGGGSQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 13093 - protein, 1072 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13094 - protein, 1397 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 13095 - protein, 1064 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13096 - protein, 667 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRGGGGSGGGGSGGGGSQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 13097 - protein, 648 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 13098 - protein, 618 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 13099 - protein, 700 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 13100 - protein, 716 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRGGGGSGGGGSGGGGSQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 13101 - protein, 655 aa, Artificial Sequence
  Synthetic Polypeptide encoding a CAR and optional  accessory module(s)
MALPVTALLLPLALLLHAARPDIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 13102 - protein, 507 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRGGGGSGGGGSGGGGSEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 13103 - protein, 507 aa, Artificial Sequence
  Synthetic Polypeptide encoding a CAR and optional  accessory module(s)
MALPVTALLLPLALLLHAARPEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSGGGGSGGGGSGGGGSEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 13104 - protein, 683 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRGGGGSGGGGSGGGGSEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 13105 - protein, 914 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRGGGGSGGGGSGGGGSEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13106 - protein, 902 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRGGGGSGGGGSGGGGSEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13107 - protein, 867 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRGGGGSGGGGSGGGGSEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13108 - protein, 877 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRGGGGSGGGGSGGGGSEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13109 - protein, 860 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRGGGGSGGGGSGGGGSEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13110 - protein, 852 aa, Artificial Sequence
  Synthetic Polypeptide encoding a CAR and optional  accessory module(s)
MALPVTALLLPLALLLHAARPEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSGGGGSGGGGSGGGGSEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 13111 - protein, 867 aa, Artificial Sequence
  Synthetic Polypeptide encoding a CAR and optional  accessory module(s)
MALPVTALLLPLALLLHAARPEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSGGGGSGGGGSGGGGSEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13112 - protein, 877 aa, Artificial Sequence
  Synthetic Polypeptide encoding a CAR and optional  accessory module(s)
MALPVTALLLPLALLLHAARPEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSGGGGSGGGGSGGGGSEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13113 - protein, 860 aa, Artificial Sequence
  Synthetic Polypeptide encoding a CAR and optional  accessory module(s)
MALPVTALLLPLALLLHAARPEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSGGGGSGGGGSGGGGSEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13114 - protein, 626 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13115 - protein, 630 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 13116 - protein, 641 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13117 - protein, 640 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13118 - protein, 636 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13119 - protein, 657 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13120 - protein, 1079 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13121 - protein, 1080 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13122 - protein, 1133 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 13123 - protein, 1083 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13124 - protein, 1079 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13125 - protein, 897 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRGGGGSGGGGSGGGGSEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13126 - protein, 1241 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRGGGGSGGGGSGGGGSEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 13127 - protein, 1080 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13128 - protein, 1405 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 13129 - protein, 1072 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13130 - protein, 675 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRGGGGSGGGGSGGGGSEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 13131 - protein, 656 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 13132 - protein, 626 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 13133 - protein, 708 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 13134 - protein, 724 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRGGGGSGGGGSGGGGSEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 13135 - protein, 663 aa, Artificial Sequence
  Synthetic Polypeptide encoding a CAR and optional  accessory module(s)
MALPVTALLLPLALLLHAARPEIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 13136 - protein, 512 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 13137 - protein, 512 aa, Artificial Sequence
  Synthetic Polypeptide encoding a CAR and optional  accessory module(s)
MALPVTALLLPLALLLHAARPQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSGGGGSGGGGSGGGGSDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 13138 - protein, 688 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 13139 - protein, 919 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13140 - protein, 907 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13141 - protein, 872 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13142 - protein, 882 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13143 - protein, 865 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13144 - protein, 857 aa, Artificial Sequence
  Synthetic Polypeptide encoding a CAR and optional  accessory module(s)
MALPVTALLLPLALLLHAARPQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSGGGGSGGGGSGGGGSDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 13145 - protein, 872 aa, Artificial Sequence
  Synthetic Polypeptide encoding a CAR and optional  accessory module(s)
MALPVTALLLPLALLLHAARPQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSGGGGSGGGGSGGGGSDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13146 - protein, 882 aa, Artificial Sequence
  Synthetic Polypeptide encoding a CAR and optional  accessory module(s)
MALPVTALLLPLALLLHAARPQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSGGGGSGGGGSGGGGSDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13147 - protein, 865 aa, Artificial Sequence
  Synthetic Polypeptide encoding a CAR and optional  accessory module(s)
MALPVTALLLPLALLLHAARPQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSGGGGSGGGGSGGGGSDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13148 - protein, 631 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13149 - protein, 635 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 13150 - protein, 646 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13151 - protein, 645 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13152 - protein, 641 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13153 - protein, 662 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13154 - protein, 1084 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13155 - protein, 1085 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13156 - protein, 1138 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 13157 - protein, 1088 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13158 - protein, 1084 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13159 - protein, 902 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13160 - protein, 1246 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 13161 - protein, 1085 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13162 - protein, 1410 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 13163 - protein, 1077 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13164 - protein, 680 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 13165 - protein, 661 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 13166 - protein, 631 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 13167 - protein, 713 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 13168 - protein, 729 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 13169 - protein, 668 aa, Artificial Sequence
  Synthetic Polypeptide encoding a CAR and optional  accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 13170 - protein, 499 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 13171 - protein, 499 aa, Artificial Sequence
  Synthetic Polypeptide encoding a CAR and optional  accessory module(s)
MALPVTALLLPLALLLHAARPQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSGGGGSGGGGSGGGGSDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 13172 - protein, 675 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 13173 - protein, 906 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13174 - protein, 894 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13175 - protein, 859 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13176 - protein, 869 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13177 - protein, 852 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13178 - protein, 844 aa, Artificial Sequence
  Synthetic Polypeptide encoding a CAR and optional  accessory module(s)
MALPVTALLLPLALLLHAARPQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSGGGGSGGGGSGGGGSDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 13179 - protein, 859 aa, Artificial Sequence
  Synthetic Polypeptide encoding a CAR and optional  accessory module(s)
MALPVTALLLPLALLLHAARPQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSGGGGSGGGGSGGGGSDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13180 - protein, 869 aa, Artificial Sequence
  Synthetic Polypeptide encoding a CAR and optional  accessory module(s)
MALPVTALLLPLALLLHAARPQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSGGGGSGGGGSGGGGSDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13181 - protein, 852 aa, Artificial Sequence
  Synthetic Polypeptide encoding a CAR and optional  accessory module(s)
MALPVTALLLPLALLLHAARPQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSGGGGSGGGGSGGGGSDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13182 - protein, 618 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13183 - protein, 622 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 13184 - protein, 633 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13185 - protein, 632 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13186 - protein, 628 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13187 - protein, 649 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 13188 - protein, 1071 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13189 - protein, 1072 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13190 - protein, 1125 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 13191 - protein, 1075 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13192 - protein, 1071 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13193 - protein, 889 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13194 - protein, 1233 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 13195 - protein, 1072 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13196 - protein, 1397 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 13197 - protein, 1064 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 13198 - protein, 667 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 13199 - protein, 648 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 13200 - protein, 618 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 13201 - protein, 700 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 13202 - protein, 716 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 13203 - protein, 655 aa, Artificial Sequence
  Synthetic Polypeptide encoding a CAR and optional  accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 13204 - protein, 10 aa, Artificial Sequence
  Synthetic Peptide encoding a CDR
ESVDNYGISF

SEQ ID NO: 13205 - protein, 6 aa, Artificial Sequence
  Synthetic Peptide encoding a CDR
QDIGNY

SEQ ID NO: 13206 - protein, 11 aa, Artificial Sequence
  Synthetic Peptide encoding a CDR
QSIVHSNGNTY

SEQ ID NO: 13207 - protein, 9 aa, Artificial Sequence
  Synthetic Peptide encoding a CDR
SSNIGAGFD

SEQ ID NO: 13208 - protein, 8 aa, Artificial Sequence
  Synthetic Peptide encoding a CDR
SSNIGSYT

SEQ ID NO: 13209 - protein, 10 aa, Artificial Sequence
  Synthetic Peptide encoding a CDR
ESVTILGSHL

SEQ ID NO: 13210 - protein, 6 aa, Artificial Sequence
  Synthetic Peptide encoding a CDR
QDISNY

SEQ ID NO: 13211 - protein, 12 aa, Artificial Sequence
  Synthetic Peptide encoding a CDR
QSILYSSNQKNY

SEQ ID NO: 13212 - protein, 12 aa, Artificial Sequence
  Synthetic Peptide encoding a CDR
QSLLNSGNQKNY

SEQ ID NO: 13213 - protein, 6 aa, Artificial Sequence
  Synthetic Peptide encoding a CDR
QGINNY

SEQ ID NO: 13214 - protein, 6 aa, Artificial Sequence
  Synthetic Peptide encoding a CDR
ENIYSN

SEQ ID NO: 13215 - protein, 11 aa, Artificial Sequence
  Synthetic Peptide encoding a CDR
KSLLNSNGNTY

SEQ ID NO: 13216 - protein, 5 aa, Artificial Sequence
  Synthetic Peptide encoding a CDR
SSVSY

SEQ ID NO: 13217 - protein, 10 aa, Artificial Sequence
  Synthetic Peptide encoding a CDR
QSVDYDGDSY

SEQ ID NO: 13218 - protein, 6 aa, Artificial Sequence
  Synthetic Peptide encoding a CDR
QDISKY

SEQ ID NO: 13219 - protein, 6 aa, Artificial Sequence
  Synthetic Peptide encoding a CDR
QDISKY

SEQ ID NO: 13220 - protein, 6 aa, Artificial Sequence
  Synthetic Peptide encoding a CDR
QDISKY

SEQ ID NO: 13221 - protein, 6 aa, Artificial Sequence
  Synthetic Peptide encoding a CDR
QDISKY

SEQ ID NO: 13222 - protein, 6 aa, Artificial Sequence
  Synthetic Peptide encoding a CDR
QSVSSY

SEQ ID NO: 13223 - protein, 11 aa, Artificial Sequence
  Synthetic Peptide encoding a CDR
KSLLHSNGITY

SEQ ID NO: 13224 - protein, 11 aa, Artificial Sequence
  Synthetic Peptide encoding a CDR
QSIVHSVGNTF

SEQ ID NO: 13225 - protein, 6 aa, Artificial Sequence
  Synthetic Peptide encoding a CDR
QSVTND

SEQ ID NO: 13226 - protein, 6 aa, Artificial Sequence
  Synthetic Peptide encoding a CDR
QTIWSY

SEQ ID NO: 13227 - protein, 6 aa, Artificial Sequence
  Synthetic Peptide encoding a CDR
QSVGGY

SEQ ID NO: 13228 - protein, 6 aa, Artificial Sequence
  Synthetic Peptide encoding a CDR
QGISSW

SEQ ID NO: 13229 - protein, 10 aa, Artificial Sequence
  Synthetic Peptide encoding a CDR
QSVDFDGDSY

SEQ ID NO: 13230 - protein, 6 aa, Artificial Sequence
  Synthetic Peptide encoding a CDR
QGISSW

SEQ ID NO: 13231 - protein, 11 aa, Artificial Sequence
  Synthetic Peptide encoding a CDR
QSIVHSDGNTY

SEQ ID NO: 13232 - protein, 5 aa, Artificial Sequence
  Synthetic Peptide encoding a CDR
SSVRY

SEQ ID NO: 13233 - protein, 12 aa, Artificial Sequence
  Synthetic Peptide encoding a CDR
QSVFFSSSQKNY

SEQ ID NO: 13234 - protein, 12 aa, Artificial Sequence
  Synthetic Peptide encoding a CDR
QSVLDSSKNKNS

SEQ ID NO: 13235 - protein, 11 aa, Artificial Sequence
  Synthetic Peptide encoding a CDR
QTIVHSNGNTY

SEQ ID NO: 13236 - protein, 11 aa, Artificial Sequence
  Synthetic Peptide encoding a CDR
QTIVHSNGNTY

SEQ ID NO: 13237 - protein, 5 aa, Artificial Sequence
  Synthetic Peptide encoding a CDR
SSINY

SEQ ID NO: 13238 - protein, 6 aa, Artificial Sequence
  Synthetic Peptide encoding a CDR
QDISTY

SEQ ID NO: 13239 - protein, 6 aa, Artificial Sequence
  Synthetic Peptide encoding a CDR
QDISTY

SEQ ID NO: 13240 - protein, 10 aa, Artificial Sequence
  Synthetic Peptide encoding a CDR
KSVSTSGYSF

SEQ ID NO: 13241 - protein, 11 aa, Artificial Sequence
  Synthetic Peptide encoding a CDR
QSLLDSDGKTY

SEQ ID NO: 13242 - protein, 10 aa, Artificial Sequence
  Synthetic Peptide encoding a CDR
QSVDYEGDSF

SEQ ID NO: 13243 - protein, 12 aa, Artificial Sequence
  Synthetic Peptide encoding a CDR
QSLLHSSNQKNY

SEQ ID NO: 13244 - protein, 7 aa, Artificial Sequence
  Synthetic Peptide encoding a CDR
QSVSSSY

SEQ ID NO: 13245 - protein, 6 aa, Artificial Sequence
  Synthetic Peptide encoding a CDR
QSISLW

SEQ ID NO: 13246 - protein, 6 aa, Artificial Sequence
  Synthetic Peptide encoding a CDR
QSISSY

SEQ ID NO: 13247 - protein, 12 aa, Artificial Sequence
  Synthetic Peptide encoding a CDR
QSLLNSRTRKNY

SEQ ID NO: 13248 - protein, 8 aa, Artificial Sequence
  Synthetic Peptide encoding a CDR
QSVNNDVY

SEQ ID NO: 13249 - protein, 6 aa, Artificial Sequence
  Synthetic Peptide encoding a CDR
QELSGY

SEQ ID NO: 13250 - protein, 10 aa, Artificial Sequence
  Synthetic Peptide encoding a CDR
ESVDSYGNSF

SEQ ID NO: 13251 - protein, 7 aa, Artificial Sequence
  Synthetic Peptide encoding a CDR
TGSITSN

SEQ ID NO: 13252 - protein, 6 aa, Artificial Sequence
  Synthetic Peptide encoding a CDR
QDVGIA

SEQ ID NO: 13253 - protein, 6 aa, Artificial Sequence
  Synthetic Peptide encoding a CDR
QDVGIA

SEQ ID NO: 13254 - protein, 6 aa, Artificial Sequence
  Synthetic Peptide encoding a CDR
QDVGIA

SEQ ID NO: 13255 - protein, 6 aa, Artificial Sequence
  Synthetic Peptide encoding a CDR
QDVITG

SEQ ID NO: 13256 - protein, 9 aa, Artificial Sequence
  Synthetic Peptide encoding a CDR
GSNIGAPYD

SEQ ID NO: 13257 - protein, 11 aa, Artificial Sequence
  Synthetic Peptide encoding a CDR
GSGSNIGAPYD

SEQ ID NO: 13258 - protein, 5 aa, Artificial Sequence
  Synthetic Peptide encoding a CDR
SSVSY

SEQ ID NO: 13259 - protein, 6 aa, Artificial Sequence
  Synthetic Peptide encoding a CDR
QSVSND

SEQ ID NO: 13260 - protein, 6 aa, Artificial Sequence
  Synthetic Peptide encoding a CDR
QSISSY

SEQ ID NO: 13261 - protein, 6 aa, Artificial Sequence
  Synthetic Peptide encoding a CDR
QSIGTN

SEQ ID NO: 13262 - protein, 11 aa, Artificial Sequence
  Synthetic Peptide encoding a CDR
QNIVHSNGNTY

SEQ ID NO: 13263 - protein, 6 aa, Artificial Sequence
  Synthetic Peptide encoding a CDR
QGIRNN

SEQ ID NO: 13264 - protein, 11 aa, Artificial Sequence
  Synthetic Peptide encoding a CDR
QSLLDSDGKTY

SEQ ID NO: 13265 - protein, 6 aa, Artificial Sequence
  Synthetic Peptide encoding a CDR
QSISSY

SEQ ID NO: 13266 - protein, 12 aa, Artificial Sequence
  Synthetic Peptide encoding a CDR
QSLLNSGNQKNY

SEQ ID NO: 13267 - protein, 11 aa, Artificial Sequence
  Synthetic Peptide encoding a CDR
QSLVHSNGNTY

SEQ ID NO: 13268 - protein, 6 aa, Artificial Sequence
  Synthetic Peptide encoding a CDR
QSISSY

SEQ ID NO: 13269 - protein, 6 aa, Artificial Sequence
  Synthetic Peptide encoding a CDR
QGVGSD

SEQ ID NO: 13270 - protein, 10 aa, Artificial Sequence
  Synthetic Peptide encoding a CDR
QSVSFAGTSL

SEQ ID NO: 13271 - protein, 6 aa, Artificial Sequence
  Synthetic Peptide encoding a CDR
QSVGSN

SEQ ID NO: 13272 - protein, 11 aa, Artificial Sequence
  Synthetic Peptide encoding a CDR
QSLVHRNGNTY

SEQ ID NO: 13273 - protein, 6 aa, Artificial Sequence
  Synthetic Peptide encoding a CDR
QSVSND

SEQ ID NO: 13274 - protein, 6 aa, Artificial Sequence
  Synthetic Peptide encoding a CDR
QDISNY

SEQ ID NO: 13275 - protein, 7 aa, Artificial Sequence
  Synthetic Peptide encoding a CDR
SAHKTYT

SEQ ID NO: 13276 - protein, 7 aa, Artificial Sequence
  Synthetic Peptide encoding a CDR
SAHKTYT

SEQ ID NO: 13277 - protein, 7 aa, Artificial Sequence
  Synthetic Peptide encoding a CDR
SAHKTYT

SEQ ID NO: 13278 - protein, 6 aa, Artificial Sequence
  Synthetic Peptide encoding a CDR
QGISSW

SEQ ID NO: 13279 - protein, 6 aa, Artificial Sequence
  Synthetic Peptide encoding a CDR
QGISSW

SEQ ID NO: 13280 - protein, 8 aa, Artificial Sequence
  Synthetic Peptide encoding a CDR
GGSIDNNY

SEQ ID NO: 13281 - protein, 5 aa, Artificial Sequence
  Synthetic Peptide encoding a CDR
SSIRY

SEQ ID NO: 13282 - protein, 11 aa, Artificial Sequence
  Synthetic Peptide encoding a CDR
QSLVHSNGNTY

SEQ ID NO: 13283 - protein, 6 aa, Artificial Sequence
  Synthetic Peptide encoding a CDR
QGIRND

SEQ ID NO: 13284 - protein, 8 aa, Artificial Sequence
  Synthetic Peptide encoding a CDR
NSNIERNY

SEQ ID NO: 13285 - protein, 8 aa, Artificial Sequence
  Synthetic Peptide encoding a CDR
RSNVGGNY

SEQ ID NO: 13286 - protein, 6 aa, Artificial Sequence
  Synthetic Peptide encoding a CDR
QDVNTA

SEQ ID NO: 13287 - protein, 6 aa, Artificial Sequence
  Synthetic Peptide encoding a CDR
YIGSSN

SEQ ID NO: 13288 - protein, 4 aa, Artificial Sequence
  Synthetic Peptide encoding a CDR
GYLN

SEQ ID NO: 13289 - protein, 4 aa, Artificial Sequence
  Synthetic Peptide encoding a CDR
SNNF

SEQ ID NO: 13290 - protein, 4 aa, Artificial Sequence
  Synthetic Peptide encoding a CDR
QYGS

SEQ ID NO: 13291 - protein, 7 aa, Artificial Sequence
  Synthetic Peptide encoding a CDR
QSVSSGS

SEQ ID NO: 13292 - protein, 6 aa, Artificial Sequence
  Synthetic Peptide encoding a CDR
QNVDTN

SEQ ID NO: 13293 - protein, 6 aa, Artificial Sequence
  Synthetic Peptide encoding a CDR
QSVGSY

SEQ ID NO: 13294 - protein, 11 aa, Artificial Sequence
  Synthetic Peptide encoding a CDR
QSLLHSNGYNY

SEQ ID NO: 13295 - protein, 6 aa, Artificial Sequence
  Synthetic Peptide encoding a CDR
QDINNY

SEQ ID NO: 13296 - protein, 7 aa, Artificial Sequence
  Synthetic Peptide encoding a CDR
LSVSSTY

SEQ ID NO: 13297 - protein, 6 aa, Artificial Sequence
  Synthetic Peptide encoding a CDR
QDVGTA

SEQ ID NO: 13298 - protein, 6 aa, Artificial Sequence
  Synthetic Peptide encoding a CDR
QDISSY

SEQ ID NO: 13299 - protein, 6 aa, Artificial Sequence
  Synthetic Peptide encoding a CDR
QSLSSY

SEQ ID NO: 13300 - protein, 6 aa, Artificial Sequence
  Synthetic Peptide encoding a CDR
AHINNW

SEQ ID NO: 13301 - protein, 12 aa, Artificial Sequence
  Synthetic Peptide encoding a CDR
HSLLNSRNQKNY

SEQ ID NO: 13302 - protein, 6 aa, Artificial Sequence
  Synthetic Peptide encoding a CDR
QDISNY

SEQ ID NO: 13303 - protein, 6 aa, Artificial Sequence
  Synthetic Peptide encoding a CDR
QDIDRY

SEQ ID NO: 13304 - protein, 7 aa, Artificial Sequence
  Synthetic Peptide encoding a CDR
SGNIHNY

SEQ ID NO: 13305 - protein, 11 aa, Artificial Sequence
  Synthetic Peptide encoding a CDR
QRIVHSNGNTY

SEQ ID NO: 13306 - protein, 6 aa, Artificial Sequence
  Synthetic Peptide encoding a CDR
VNIYSY

SEQ ID NO: 13307 - protein, 6 aa, Artificial Sequence
  Synthetic Peptide encoding a CDR
QNVGNN

SEQ ID NO: 13308 - protein, 9 aa, Artificial Sequence
  Synthetic Peptide encoding a CDR
SSNIGAGYD

SEQ ID NO: 13309 - protein, 8 aa, Artificial Sequence
  Synthetic Peptide encoding a CDR
SSNIGSNY

SEQ ID NO: 13310 - protein, 6 aa, Artificial Sequence
  Synthetic Peptide encoding a CDR
QSISSY

SEQ ID NO: 13311 - protein, 6 aa, Artificial Sequence
  Synthetic Peptide encoding a CDR
EDIYIR

SEQ ID NO: 13312 - protein, 6 aa, Artificial Sequence
  Synthetic Peptide encoding a CDR
EDIYIR

SEQ ID NO: 13313 - protein, 6 aa, Artificial Sequence
  Synthetic Peptide encoding a CDR
EDIYIR

SEQ ID NO: 13314 - protein, 5 aa, Artificial Sequence
  Synthetic Peptide encoding a CDR
SSVSY

SEQ ID NO: 13315 - protein, 11 aa, Artificial Sequence
  Synthetic Peptide encoding a CDR
KSLLHSNGNTY

SEQ ID NO: 13316 - protein, 11 aa, Artificial Sequence
  Synthetic Peptide encoding a CDR
KSLLHSNGNTY

SEQ ID NO: 13317 - protein, 8 aa, Artificial Sequence
  Synthetic Peptide encoding a CDR
SDVGGYNY

SEQ ID NO: 13318 - protein, 10 aa, Artificial Sequence
  Synthetic Peptide encoding a CDR
ESVEYYGTSL

SEQ ID NO: 13319 - protein, 7 aa, Artificial Sequence
  Synthetic Peptide encoding a CDR
QSVSSSY

SEQ ID NO: 13320 - protein, 6 aa, Artificial Sequence
  Synthetic Peptide encoding a CDR
QSVSSY

SEQ ID NO: 13321 - protein, 11 aa, Artificial Sequence
  Synthetic Peptide encoding a CDR
QSLLNSRTRKN

SEQ ID NO: 13322 - protein, 7 aa, Artificial Sequence
  Synthetic Peptide encoding a CDR
QSVSSSY

SEQ ID NO: 13323 - protein, 11 aa, Artificial Sequence
  Synthetic Peptide encoding a CDR
QSLLDSDGKTY

SEQ ID NO: 13324 - protein, 9 aa, Artificial Sequence
  Synthetic Peptide encoding a CDR
ERDVGGYNY

SEQ ID NO: 13325 - protein, 6 aa, Artificial Sequence
  Synthetic Peptide encoding a CDR
QSVSSY

SEQ ID NO: 13326 - protein, 6 aa, Artificial Sequence
  Synthetic Peptide encoding a CDR
QSVSSY

SEQ ID NO: 13327 - protein, 6 aa, Artificial Sequence
  Synthetic Peptide encoding a CDR
QGISSW

SEQ ID NO: 13328 - protein, 6 aa, Artificial Sequence
  Synthetic Peptide encoding a CDR
QDVSTA

SEQ ID NO: 13329 - protein, 8 aa, Artificial Sequence
  Synthetic Peptide encoding a CDR
ESVYSNNY

SEQ ID NO: 13330 - protein, 9 aa, Artificial Sequence
  Synthetic Peptide encoding a CDR
KSVSTSGYS

SEQ ID NO: 13331 - protein, 6 aa, Artificial Sequence
  Synthetic Peptide encoding a CDR
RGISSW

SEQ ID NO: 13332 - protein, 11 aa, Artificial Sequence
  Synthetic Peptide encoding a CDR
QSLLHSNGYNY

SEQ ID NO: 13333 - protein, 6 aa, Artificial Sequence
  Synthetic Peptide encoding a CDR
QGISNY

SEQ ID NO: 13334 - protein, 6 aa, Artificial Sequence
  Synthetic Peptide encoding a CDR
QDVGTA

SEQ ID NO: 13335 - protein, 6 aa, Artificial Sequence
  Synthetic Peptide encoding a CDR
QDIYPY

SEQ ID NO: 13336 - protein, 6 aa, Artificial Sequence
  Synthetic Peptide encoding a CDR
QNVGTN

SEQ ID NO: 13337 - protein, 6 aa, Artificial Sequence
  Synthetic Peptide encoding a CDR
PDINSY

SEQ ID NO: 13338 - protein, 4 aa, Artificial Sequence
  Synthetic Peptide encoding a CDR
KSQY

SEQ ID NO: 13339 - protein, 8 aa, Artificial Sequence
  Synthetic Peptide encoding a CDR
SSNIGSNF

SEQ ID NO: 13340 - protein, 6 aa, Artificial Sequence
  Synthetic Peptide encoding a CDR
QSVSSN

SEQ ID NO: 13341 - protein, 5 aa, Artificial Sequence
  Synthetic Peptide encoding a CDR
SSVSY

SEQ ID NO: 13342 - protein, 6 aa, Artificial Sequence
  Synthetic Peptide encoding a CDR
QSISSY

SEQ ID NO: 13343 - protein, 11 aa, Artificial Sequence
  Synthetic Peptide encoding a CDR
QRLVHSNGNTY

SEQ ID NO: 13344 - protein, 6 aa, Artificial Sequence
  Synthetic Peptide encoding a CDR
QLGGKY

SEQ ID NO: 13345 - protein, 8 aa, Artificial Sequence
  Synthetic Peptide encoding a CDR
SGSIASKY

SEQ ID NO: 13346 - protein, 6 aa, Artificial Sequence
  Synthetic Peptide encoding a CDR
QNINVW

SEQ ID NO: 13347 - protein, 7 aa, Artificial Sequence
  Synthetic Peptide encoding a CDR
QSVSSSY

SEQ ID NO: 13348 - protein, 6 aa, Artificial Sequence
  Synthetic Peptide encoding a CDR
QRFGDY

SEQ ID NO: 13349 - protein, 6 aa, Artificial Sequence
  Synthetic Peptide encoding a CDR
QSVRSY

SEQ ID NO: 13350 - protein, 12 aa, Artificial Sequence
  Synthetic Peptide encoding a CDR
RSLLDSDDGNTY

SEQ ID NO: 13351 - protein, 6 aa, Artificial Sequence
  Synthetic Peptide encoding a CDR
QDIFKN

SEQ ID NO: 13352 - protein, 6 aa, Artificial Sequence
  Synthetic Peptide encoding a CDR
QNIGTS

SEQ ID NO: 13353 - protein, 12 aa, Artificial Sequence
  Synthetic Peptide encoding a CDR
QSLLNSGDQKNY

SEQ ID NO: 13354 - protein, 6 aa, Artificial Sequence
  Synthetic Peptide encoding a CDR
QDVSIA

SEQ ID NO: 13355 - protein, 10 aa, Artificial Sequence
  Synthetic Peptide encoding a CDR
KSVSTSGYSY

SEQ ID NO: 13356 - protein, 6 aa, Artificial Sequence
  Synthetic Peptide encoding a CDR
QSISNY

SEQ ID NO: 13357 - protein, 6 aa, Artificial Sequence
  Synthetic Peptide encoding a CDR
KLGDKY

SEQ ID NO: 13358 - protein, 6 aa, Artificial Sequence
  Synthetic Peptide encoding a CDR
QNVGTF

SEQ ID NO: 13359 - protein, 6 aa, Artificial Sequence
  Synthetic Peptide encoding a CDR
QSIGTS

SEQ ID NO: 13360 - protein, 11 aa, Artificial Sequence
  Synthetic Peptide encoding a CDR
QSLLHSIGYNY

SEQ ID NO: 13361 - protein, 11 aa, Artificial Sequence
  Synthetic Peptide encoding a CDR
QSLLHSIGYNY

SEQ ID NO: 13362 - protein, 11 aa, Artificial Sequence
  Synthetic Peptide encoding a CDR
QSLLHSNGHNY

SEQ ID NO: 13363 - protein, 7 aa, Artificial Sequence
  Synthetic Peptide encoding a CDR
QSISSSF

SEQ ID NO: 13364 - protein, 8 aa, Artificial Sequence
  Synthetic Peptide encoding a CDR
SSNIGSNT

SEQ ID NO: 13365 - protein, 6 aa, Artificial Sequence
  Synthetic Peptide encoding a CDR
QNINKW

SEQ ID NO: 13366 - protein, 8 aa, Artificial Sequence
  Synthetic Peptide encoding a CDR
SSNIGSNY

SEQ ID NO: 13367 - protein, 6 aa, Artificial Sequence
  Synthetic Peptide encoding a CDR
NIGSKS

SEQ ID NO: 13368 - protein, 9 aa, Artificial Sequence
  Synthetic Peptide encoding a CDR
TGAVTTSNY

SEQ ID NO: 13369 - protein, 11 aa, Artificial Sequence
  Synthetic Peptide encoding a CDR
SESVDNYGNTF

SEQ ID NO: 13370 - protein, 7 aa, Artificial Sequence
  Synthetic Peptide encoding a CDR
QSVSNTY

SEQ ID NO: 13371 - protein, 6 aa, Artificial Sequence
  Synthetic Peptide encoding a CDR
SLRSNY

SEQ ID NO: 13372 - protein, 6 aa, Artificial Sequence
  Synthetic Peptide encoding a CDR
QSISNN

SEQ ID NO: 13373 - protein, 5 aa, Artificial Sequence
  Synthetic Peptide encoding a CDR
SSVNY

SEQ ID NO: 13374 - protein, 5 aa, Artificial Sequence
  Synthetic Peptide encoding a CDR
SSISY

SEQ ID NO: 13375 - protein, 6 aa, Artificial Sequence
  Synthetic Peptide encoding a CDR
QGFNKY

SEQ ID NO: 13376 - protein, 10 aa, Artificial Sequence
  Synthetic Peptide encoding a CDR
QSVDYDGDSY

SEQ ID NO: 13377 - protein, 6 aa, Artificial Sequence
  Synthetic Peptide encoding a CDR
QDIRYY

SEQ ID NO: 13378 - protein, 6 aa, Artificial Sequence
  Synthetic Peptide encoding a CDR
QSVSRN

SEQ ID NO: 13379 - protein, 6 aa, Artificial Sequence
  Synthetic Peptide encoding a CDR
QSVSRN

SEQ ID NO: 13380 - protein, 6 aa, Artificial Sequence
  Synthetic Peptide encoding a CDR
KNIRSY

SEQ ID NO: 13381 - protein, 9 aa, Artificial Sequence
  Synthetic Peptide encoding a CDR
SSDVGGYNY

SEQ ID NO: 13382 - protein, 9 aa, Artificial Sequence
  Synthetic Peptide encoding a CDR
SSSNIGNNY

SEQ ID NO: 13383 - protein, 9 aa, Artificial Sequence
  Synthetic Peptide encoding a CDR
SSNIGAGYD

SEQ ID NO: 13384 - protein, 8 aa, Artificial Sequence
  Synthetic Peptide encoding a CDR
SSNIGSNS

SEQ ID NO: 13385 - protein, 11 aa, Artificial Sequence
  Synthetic Peptide encoding a CDR
SESVSVIGAHL

SEQ ID NO: 13386 - protein, 10 aa, Artificial Sequence
  Synthetic Peptide encoding a CDR
ESVTILGSHL

SEQ ID NO: 13387 - protein, 12 aa, Artificial Sequence
  Synthetic Peptide encoding a CDR
QSLLNSGNQKNY

SEQ ID NO: 13388 - protein, 12 aa, Artificial Sequence
  Synthetic Peptide encoding a CDR
QSLLNSGNQKNY

SEQ ID NO: 13389 - protein, 7 aa, Artificial Sequence
  Synthetic Peptide encoding a CDR
QSVSSSY

SEQ ID NO: 13390 - protein, 8 aa, Artificial Sequence
  Synthetic Peptide encoding a CDR
TGNIGSNY

SEQ ID NO: 13391 - protein, 6 aa, Artificial Sequence
  Synthetic Peptide encoding a CDR
EDIHSN

SEQ ID NO: 13392 - protein, 6 aa, Artificial Sequence
  Synthetic Peptide encoding a CDR
QSVSSY

SEQ ID NO: 13393 - protein, 7 aa, Artificial Sequence
  Synthetic Peptide encoding a CDR
SKSISKD

SEQ ID NO: 13394 - protein, 6 aa, Artificial Sequence
  Synthetic Peptide encoding a CDR
KDIYSN

SEQ ID NO: 13395 - protein, 5 aa, Artificial Sequence
  Synthetic Peptide encoding a CDR
SSINY

SEQ ID NO: 13396 - protein, 12 aa, Artificial Sequence
  Synthetic Peptide encoding a CDR
QSFLSSGDGKNY

SEQ ID NO: 13397 - protein, 11 aa, Artificial Sequence
  Synthetic Peptide encoding a CDR
QSLVHSDGDTY

SEQ ID NO: 13398 - protein, 10 aa, Artificial Sequence
  Synthetic Peptide encoding a CDR
ESVDTFGISF

SEQ ID NO: 13399 - protein, 6 aa, Artificial Sequence
  Synthetic Peptide encoding a CDR
QGISSA

SEQ ID NO: 13400 - protein, 11 aa, Artificial Sequence
  Synthetic Peptide encoding a CDR
KSLQNVNGNTY

SEQ ID NO: 13401 - protein, 10 aa, Artificial Sequence
  Synthetic Peptide encoding a CDR
QSVDYDGDSY

SEQ ID NO: 13402 - protein, 6 aa, Artificial Sequence
  Synthetic Peptide encoding a CDR
QSVDNY

SEQ ID NO: 13403 - protein, 6 aa, Artificial Sequence
  Synthetic Peptide encoding a CDR
QNVGTN

SEQ ID NO: 13404 - protein, 5 aa, Artificial Sequence
  Synthetic Peptide encoding a CDR
SGVNY

SEQ ID NO: 13405 - protein, 6 aa, Artificial Sequence
  Synthetic Peptide encoding a CDR
DHINNW

SEQ ID NO: 13406 - protein, 10 aa, Artificial Sequence
  Synthetic Peptide encoding a CDR
QSVDYDGDSY

SEQ ID NO: 13407 - protein, 5 aa, Artificial Sequence
  Synthetic Peptide encoding a CDR
SSVNY

SEQ ID NO: 13408 - protein, 6 aa, Artificial Sequence
  Synthetic Peptide encoding a CDR
QSVSSY

SEQ ID NO: 13409 - protein, 6 aa, Artificial Sequence
  Synthetic Peptide encoding a CDR
QSVSSY

SEQ ID NO: 13410 - protein, 5 aa, Artificial Sequence
  Synthetic Peptide encoding a CDR
SSVSY

SEQ ID NO: 13411 - protein, 5 aa, Artificial Sequence
  Synthetic Peptide encoding a CDR
SSVSY

SEQ ID NO: 13412 - protein, 6 aa, Artificial Sequence
  Synthetic Peptide encoding a CDR
QSNSND

SEQ ID NO: 13413 - protein, 5 aa, Artificial Sequence
  Synthetic Peptide encoding a CDR
SSVSY

SEQ ID NO: 13414 - protein, 5 aa, Artificial Sequence
  Synthetic Peptide encoding a CDR
SSLSF

SEQ ID NO: 13415 - protein, 6 aa, Artificial Sequence
  Synthetic Peptide encoding a CDR
QSVSSY

SEQ ID NO: 13416 - protein, 5 aa, Artificial Sequence
  Synthetic Peptide encoding a CDR
SSVPY

SEQ ID NO: 13417 - protein, 6 aa, Artificial Sequence
  Synthetic Peptide encoding a CDR
QGISSV

SEQ ID NO: 13418 - protein, 6 aa, Artificial Sequence
  Synthetic Peptide encoding a CDR
QDINKY

SEQ ID NO: 13419 - protein, 6 aa, Artificial Sequence
  Synthetic Peptide encoding a CDR
QDINSY

SEQ ID NO: 13420 - protein, 11 aa, Artificial Sequence
  Synthetic Peptide encoding a CDR
QSLLHSNGYNY

SEQ ID NO: 13421 - protein, 10 aa, Artificial Sequence
  Synthetic Peptide encoding a CDR
ESVDSYGNSY

SEQ ID NO: 13422 - protein, 6 aa, Artificial Sequence
  Synthetic Peptide encoding a CDR
QGIRND

SEQ ID NO: 13423 - protein, 11 aa, Artificial Sequence
  Synthetic Peptide encoding a CDR
QSLLDGDGKTY

SEQ ID NO: 13424 - protein, 6 aa, Artificial Sequence
  Synthetic Peptide encoding a CDR
QDVSTA

SEQ ID NO: 13425 - protein, 10 aa, Artificial Sequence
  Synthetic Peptide encoding a CDR
QSVSTSSYNY

SEQ ID NO: 13426 - protein, 7 aa, Artificial Sequence
  Synthetic Peptide encoding a CDR
SNVISSY

SEQ ID NO: 13427 - protein, 7 aa, Artificial Sequence
  Synthetic Peptide encoding a CDR
SNVISSY

SEQ ID NO: 13428 - protein, 6 aa, Artificial Sequence
  Synthetic Peptide encoding a CDR
QDVSTA

SEQ ID NO: 13429 - protein, 11 aa, Artificial Sequence
  Synthetic Peptide encoding a CDR
QSLVHNNGNTY

SEQ ID NO: 13430 - protein, 11 aa, Artificial Sequence
  Synthetic Peptide encoding a CDR
QSLVHSNGLTY

SEQ ID NO: 13431 - protein, 11 aa, Artificial Sequence
  Synthetic Peptide encoding a CDR
QSLVHSNGNTY

SEQ ID NO: 13432 - protein, 6 aa, Artificial Sequence
  Synthetic Peptide encoding a CDR
DHINNW

SEQ ID NO: 13433 - protein, 6 aa, Artificial Sequence
  Synthetic Peptide encoding a CDR
QDVSTA

SEQ ID NO: 13434 - protein, 11 aa, Artificial Sequence
  Synthetic Peptide encoding a CDR
QSLVHSNGNTY

SEQ ID NO: 13435 - protein, 8 aa, Artificial Sequence
  Synthetic Peptide encoding a CDR
TSNIGNNY

SEQ ID NO: 13436 - protein, 9 aa, Artificial Sequence
  Synthetic Peptide encoding a CDR
SSNIGAGYD

SEQ ID NO: 13437 - protein, 9 aa, Artificial Sequence
  Synthetic Peptide encoding a CDR
SSDVGGYNY

SEQ ID NO: 13438 - protein, 6 aa, Artificial Sequence
  Synthetic Peptide encoding a CDR
LDISHY

SEQ ID NO: 13439 - protein, 8 aa, Artificial Sequence
  Synthetic Peptide encoding a CDR
SSNIGTRM

SEQ ID NO: 13440 - protein, 7 aa, Artificial Sequence
  Synthetic Peptide encoding a CDR
NNIGMKS

SEQ ID NO: 13441 - protein, 6 aa, Artificial Sequence
  Synthetic Peptide encoding a CDR
QGISSW

SEQ ID NO: 13442 - protein, 12 aa, Artificial Sequence
  Synthetic Peptide encoding a CDR
QSLLNSGDQKNY

SEQ ID NO: 13443 - protein, 11 aa, Artificial Sequence
  Synthetic Peptide encoding a CDR
QSILHSTGDTY

SEQ ID NO: 13444 - protein, 6 aa, Artificial Sequence
  Synthetic Peptide encoding a CDR
QSVSIY

SEQ ID NO: 13445 - protein, 6 aa, Artificial Sequence
  Synthetic Peptide encoding a CDR
QGISSW

SEQ ID NO: 13446 - protein, 6 aa, Artificial Sequence
  Synthetic Peptide encoding a CDR
NIGSKS

SEQ ID NO: 13447 - protein, 9 aa, Artificial Sequence
  Synthetic Peptide encoding a CDR
SSNIGAGYD

SEQ ID NO: 13448 - protein, 8 aa, Artificial Sequence
  Synthetic Peptide encoding a CDR
SGSIASNY

SEQ ID NO: 13449 - protein, 5 aa, Artificial Sequence
  Synthetic Peptide encoding a CDR
SSVSY

SEQ ID NO: 13450 - protein, 12 aa, Artificial Sequence
  Synthetic Peptide encoding a CDR
QSLLNSGNQKNY

SEQ ID NO: 13451 - protein, 6 aa, Artificial Sequence
  Synthetic Peptide encoding a CDR
QDISNY

SEQ ID NO: 13452 - protein, 12 aa, Artificial Sequence
  Synthetic Peptide encoding a CDR
QSLLNSSNQKNY

SEQ ID NO: 13453 - protein, 8 aa, Artificial Sequence
  Synthetic Peptide encoding a CDR
SSNIGNNY

SEQ ID NO: 13454 - protein, 11 aa, Artificial Sequence
  Synthetic Peptide encoding a CDR
QSIVHRTGNTY

SEQ ID NO: 13455 - protein, 10 aa, Artificial Sequence
  Synthetic Peptide encoding a CDR
ESVDSYGKSF

SEQ ID NO: 13456 - protein, 10 aa, Artificial Sequence
  Synthetic Peptide encoding a CDR
ESVTILGSHL

SEQ ID NO: 13457 - protein, 9 aa, Artificial Sequence
  Synthetic Peptide encoding a CDR
ESVTILGSH

SEQ ID NO: 13458 - protein, 6 aa, Artificial Sequence
  Synthetic Peptide encoding a CDR
EDIYIR

SEQ ID NO: 13459 - protein, 11 aa, Artificial Sequence
  Synthetic Peptide encoding a CDR
QSIVHSTGNTY

SEQ ID NO: 13460 - protein, 6 aa, Artificial Sequence
  Synthetic Peptide encoding a CDR
SLRSYY

SEQ ID NO: 13461 - protein, 9 aa, Artificial Sequence
  Synthetic Peptide encoding a CDR
SSDVGGYNY

SEQ ID NO: 13462 - protein, 9 aa, Artificial Sequence
  Synthetic Peptide encoding a CDR
SSDVGGYNY

SEQ ID NO: 13463 - protein, 9 aa, Artificial Sequence
  Synthetic Peptide encoding a CDR
SSDVGGYNY

SEQ ID NO: 13464 - protein, 9 aa, Artificial Sequence
  Synthetic Peptide encoding a CDR
SSDVGGYNY

SEQ ID NO: 13465 - protein, 6 aa, Artificial Sequence
  Synthetic Peptide encoding a CDR
QDISKY

SEQ ID NO: 13466 - protein, 5 aa, Artificial Sequence
  Synthetic Peptide encoding a CDR
SSVSY

SEQ ID NO: 13467 - protein, 6 aa, Artificial Sequence
  Synthetic Peptide encoding a CDR
EDIYIR

SEQ ID NO: 13468 - protein, 6 aa, Artificial Sequence
  Synthetic Peptide encoding a CDR
QGISTD

SEQ ID NO: 13469 - protein, 6 aa, Artificial Sequence
  Synthetic Peptide encoding a CDR
LGISTW

SEQ ID NO: 13470 - protein, 6 aa, Artificial Sequence
  Synthetic Peptide encoding a CDR
ENVYSY

SEQ ID NO: 13471 - protein, 6 aa, Artificial Sequence
  Synthetic Peptide encoding a CDR
ENVYSY

SEQ ID NO: 13472 - protein, 7 aa, Artificial Sequence
  Synthetic Peptide encoding a CDR
QSVRSSY

SEQ ID NO: 13473 - protein, 7 aa, Artificial Sequence
  Synthetic Peptide encoding a CDR
QSIRSSY

SEQ ID NO: 13474 - protein, 7 aa, Artificial Sequence
  Synthetic Peptide encoding a CDR
QSVRGNY

SEQ ID NO: 13475 - protein, 7 aa, Artificial Sequence
  Synthetic Peptide encoding a CDR
QSVRGNY

SEQ ID NO: 13476 - protein, 6 aa, Artificial Sequence
  Synthetic Peptide encoding a CDR
QSVSSY

SEQ ID NO: 13477 - protein, 6 aa, Artificial Sequence
  Synthetic Peptide encoding a CDR
QSVSSY

SEQ ID NO: 13478 - protein, 6 aa, Artificial Sequence
  Synthetic Peptide encoding a CDR
QGISSA

SEQ ID NO: 13479 - protein, 7 aa, Artificial Sequence
  Synthetic Peptide encoding a CDR
QSVRSSY

SEQ ID NO: 13480 - protein, 7 aa, Artificial Sequence
  Synthetic Peptide encoding a CDR
QSVRSNY

SEQ ID NO: 13481 - protein, 9 aa, Artificial Sequence
  Synthetic Peptide encoding a CDR
HNYVSWCQQ

SEQ ID NO: 13482 - protein, 9 aa, Artificial Sequence
  Synthetic Peptide encoding a CDR
HNLVSWCQH

SEQ ID NO: 13483 - protein, 9 aa, Artificial Sequence
  Synthetic Peptide encoding a CDR
HNYVSWCQH

SEQ ID NO: 13484 - protein, 7 aa, Artificial Sequence
  Synthetic Peptide encoding a CDR
QSGWKAW

SEQ ID NO: 13485 - protein, 7 aa, Artificial Sequence
  Synthetic Peptide encoding a CDR
QSGWKAW

SEQ ID NO: 13486 - protein, 9 aa, Artificial Sequence
  Synthetic Peptide encoding a CDR
RHIISAWFQ

SEQ ID NO: 13487 - protein, 7 aa, Artificial Sequence
  Synthetic Peptide encoding a CDR
EGWLAWY

SEQ ID NO: 13488 - protein, 6 aa, Artificial Sequence
  Synthetic Peptide encoding a CDR
EGWLAW

SEQ ID NO: 13489 - protein, 7 aa, Artificial Sequence
  Synthetic Peptide encoding a CDR
QSFSSSN

SEQ ID NO: 13490 - protein, 7 aa, Artificial Sequence
  Synthetic Peptide encoding a CDR
QSFSSSY

SEQ ID NO: 13491 - protein, 7 aa, Artificial Sequence
  Synthetic Peptide encoding a CDR
QTVRSSF

SEQ ID NO: 13492 - protein, 7 aa, Artificial Sequence
  Synthetic Peptide encoding a CDR
QSVSTKY

SEQ ID NO: 13493 - protein, 7 aa, Artificial Sequence
  Synthetic Peptide encoding a CDR
QSISSSQ

SEQ ID NO: 13494 - protein, 7 aa, Artificial Sequence
  Synthetic Peptide encoding a CDR
QSISSSQ

SEQ ID NO: 13495 - protein, 7 aa, Artificial Sequence
  Synthetic Peptide encoding a CDR
QSVSSNY

SEQ ID NO: 13496 - protein, 7 aa, Artificial Sequence
  Synthetic Peptide encoding a CDR
QSVSSSQ

SEQ ID NO: 13497 - protein, 7 aa, Artificial Sequence
  Synthetic Peptide encoding a CDR
QSVVSNY

SEQ ID NO: 13498 - protein, 8 aa, Artificial Sequence
  Synthetic Peptide encoding a CDR
SGTIATNY

SEQ ID NO: 13499 - protein, 8 aa, Artificial Sequence
  Synthetic Peptide encoding a CDR
SGTIATNY

SEQ ID NO: 13500 - protein, 6 aa, Artificial Sequence
  Synthetic Peptide encoding a CDR
VNIYSY

SEQ ID NO: 13501 - protein, 6 aa, Artificial Sequence
  Synthetic Peptide encoding a CDR
QNVGNN

SEQ ID NO: 13502 - protein, 10 aa, Artificial Sequence
  Synthetic Peptide encoding a CDR
ESVSVIGAHL

SEQ ID NO: 13503 - protein, 10 aa, Artificial Sequence
  Synthetic Peptide encoding a CDR
ESVSVIGAHL

SEQ ID NO: 13504 - protein, 10 aa, Artificial Sequence
  Synthetic Peptide encoding a CDR
ESVSVIGAHL

SEQ ID NO: 13505 - protein, 10 aa, Artificial Sequence
  Synthetic Peptide encoding a CDR
ESVTILGSHL

SEQ ID NO: 13506 - protein, 10 aa, Artificial Sequence
  Synthetic Peptide encoding a CDR
ESVTILGSHL

SEQ ID NO: 13507 - protein, 10 aa, Artificial Sequence
  Synthetic Peptide encoding a CDR
ESVTILGSHL

SEQ ID NO: 13508 - protein, 10 aa, Artificial Sequence
  Synthetic Peptide encoding a CDR
ESVSVIGAHL

SEQ ID NO: 13509 - protein, 5 aa, Artificial Sequence
  Synthetic Peptide encoding a CDR
QDISN

SEQ ID NO: 13510 - protein, 4 aa, Artificial Sequence
  Synthetic Peptide encoding a CDR
RASN

SEQ ID NO: 13511 - protein, 4 aa, Artificial Sequence
  Synthetic Peptide encoding a CDR
YTSR

SEQ ID NO: 13512 - protein, 4 aa, Artificial Sequence
  Synthetic Peptide encoding a CDR
KVSN

SEQ ID NO: 13513 - protein, 4 aa, Artificial Sequence
  Synthetic Peptide encoding a CDR
GNSN

SEQ ID NO: 13514 - protein, 4 aa, Artificial Sequence
  Synthetic Peptide encoding a CDR
SNNQ

SEQ ID NO: 13515 - protein, 4 aa, Artificial Sequence
  Synthetic Peptide encoding a CDR
LASN

SEQ ID NO: 13516 - protein, 4 aa, Artificial Sequence
  Synthetic Peptide encoding a CDR
YTSN

SEQ ID NO: 13517 - protein, 4 aa, Artificial Sequence
  Synthetic Peptide encoding a CDR
WAST

SEQ ID NO: 13518 - protein, 4 aa, Artificial Sequence
  Synthetic Peptide encoding a CDR
WAST

SEQ ID NO: 13519 - protein, 4 aa, Artificial Sequence
  Synthetic Peptide encoding a CDR
YTST

SEQ ID NO: 13520 - protein, 4 aa, Artificial Sequence
  Synthetic Peptide encoding a CDR
AATN

SEQ ID NO: 13521 - protein, 4 aa, Artificial Sequence
  Synthetic Peptide encoding a CDR
RMSN

SEQ ID NO: 13522 - protein, 4 aa, Artificial Sequence
  Synthetic Peptide encoding a CDR
DTSK

SEQ ID NO: 13523 - protein, 4 aa, Artificial Sequence
  Synthetic Peptide encoding a CDR
DASN

SEQ ID NO: 13524 - protein, 4 aa, Artificial Sequence
  Synthetic Peptide encoding a CDR
HTSR

SEQ ID NO: 13525 - protein, 4 aa, Artificial Sequence
  Synthetic Peptide encoding a CDR
HTSR

SEQ ID NO: 13526 - protein, 4 aa, Artificial Sequence
  Synthetic Peptide encoding a CDR
HTSR

SEQ ID NO: 13527 - protein, 4 aa, Artificial Sequence
  Synthetic Peptide encoding a CDR
HTSR

SEQ ID NO: 13528 - protein, 4 aa, Artificial Sequence
  Synthetic Peptide encoding a CDR
DASN

SEQ ID NO: 13529 - protein, 4 aa, Artificial Sequence
  Synthetic Peptide encoding a CDR
QMSN

SEQ ID NO: 13530 - protein, 4 aa, Artificial Sequence
  Synthetic Peptide encoding a CDR
KVSN

SEQ ID NO: 13531 - protein, 4 aa, Artificial Sequence
  Synthetic Peptide encoding a CDR
YASN

SEQ ID NO: 13532 - protein, 4 aa, Artificial Sequence
  Synthetic Peptide encoding a CDR
AASS

SEQ ID NO: 13533 - protein, 4 aa, Artificial Sequence
  Synthetic Peptide encoding a CDR
DASN

SEQ ID NO: 13534 - protein, 4 aa, Artificial Sequence
  Synthetic Peptide encoding a CDR
AASS

SEQ ID NO: 13535 - protein, 4 aa, Artificial Sequence
  Synthetic Peptide encoding a CDR
AAST

SEQ ID NO: 13536 - protein, 4 aa, Artificial Sequence
  Synthetic Peptide encoding a CDR
AASS

SEQ ID NO: 13537 - protein, 4 aa, Artificial Sequence
  Synthetic Peptide encoding a CDR
KVSN

SEQ ID NO: 13538 - protein, 4 aa, Artificial Sequence
  Synthetic Peptide encoding a CDR
LTSN

SEQ ID NO: 13539 - protein, 4 aa, Artificial Sequence
  Synthetic Peptide encoding a CDR
WAST

SEQ ID NO: 13540 - protein, 4 aa, Artificial Sequence
  Synthetic Peptide encoding a CDR
WAST

SEQ ID NO: 13541 - protein, 4 aa, Artificial Sequence
  Synthetic Peptide encoding a CDR
QVSN

SEQ ID NO: 13542 - protein, 4 aa, Artificial Sequence
  Synthetic Peptide encoding a CDR
QVSN

SEQ ID NO: 13543 - protein, 4 aa, Artificial Sequence
  Synthetic Peptide encoding a CDR
LTSN

SEQ ID NO: 13544 - protein, 4 aa, Artificial Sequence
  Synthetic Peptide encoding a CDR
YTSR

SEQ ID NO: 13545 - protein, 4 aa, Artificial Sequence
  Synthetic Peptide encoding a CDR
YTSR

SEQ ID NO: 13546 - protein, 4 aa, Artificial Sequence
  Synthetic Peptide encoding a CDR
LASN

SEQ ID NO: 13547 - protein, 4 aa, Artificial Sequence
  Synthetic Peptide encoding a CDR
LVSK

SEQ ID NO: 13548 - protein, 4 aa, Artificial Sequence
  Synthetic Peptide encoding a CDR
AASN

SEQ ID NO: 13549 - protein, 4 aa, Artificial Sequence
  Synthetic Peptide encoding a CDR
WAST

SEQ ID NO: 13550 - protein, 4 aa, Artificial Sequence
  Synthetic Peptide encoding a CDR
GTSS

SEQ ID NO: 13551 - protein, 4 aa, Artificial Sequence
  Synthetic Peptide encoding a CDR
AAST

SEQ ID NO: 13552 - protein, 4 aa, Artificial Sequence
  Synthetic Peptide encoding a CDR
AVST

SEQ ID NO: 13553 - protein, 4 aa, Artificial Sequence
  Synthetic Peptide encoding a CDR
WAST

SEQ ID NO: 13554 - protein, 4 aa, Artificial Sequence
  Synthetic Peptide encoding a CDR
WAST

SEQ ID NO: 13555 - protein, 4 aa, Artificial Sequence
  Synthetic Peptide encoding a CDR
AAST

SEQ ID NO: 13556 - protein, 4 aa, Artificial Sequence
  Synthetic Peptide encoding a CDR
LASN

SEQ ID NO: 13557 - protein, 4 aa, Artificial Sequence
  Synthetic Peptide encoding a CDR
EDNE

SEQ ID NO: 13558 - protein, 4 aa, Artificial Sequence
  Synthetic Peptide encoding a CDR
WAST

SEQ ID NO: 13559 - protein, 4 aa, Artificial Sequence
  Synthetic Peptide encoding a CDR
WAST

SEQ ID NO: 13560 - protein, 4 aa, Artificial Sequence
  Synthetic Peptide encoding a CDR
WAST

SEQ ID NO: 13561 - protein, 4 aa, Artificial Sequence
  Synthetic Peptide encoding a CDR
SAST

SEQ ID NO: 13562 - protein, 4 aa, Artificial Sequence
  Synthetic Peptide encoding a CDR
HNNK

SEQ ID NO: 13563 - protein, 4 aa, Artificial Sequence
  Synthetic Peptide encoding a CDR
HNNK

SEQ ID NO: 13564 - protein, 4 aa, Artificial Sequence
  Synthetic Peptide encoding a CDR
LTSN

SEQ ID NO: 13565 - protein, 4 aa, Artificial Sequence
  Synthetic Peptide encoding a CDR
YASN

SEQ ID NO: 13566 - protein, 4 aa, Artificial Sequence
  Synthetic Peptide encoding a CDR
LASN

SEQ ID NO: 13567 - protein, 4 aa, Artificial Sequence
  Synthetic Peptide encoding a CDR
YASE

SEQ ID NO: 13568 - protein, 4 aa, Artificial Sequence
  Synthetic Peptide encoding a CDR
KVSN

SEQ ID NO: 13569 - protein, 4 aa, Artificial Sequence
  Synthetic Peptide encoding a CDR
AASN

SEQ ID NO: 13570 - protein, 4 aa, Artificial Sequence
  Synthetic Peptide encoding a CDR
LVSK

SEQ ID NO: 13571 - protein, 4 aa, Artificial Sequence
  Synthetic Peptide encoding a CDR
WAST

SEQ ID NO: 13572 - protein, 4 aa, Artificial Sequence
  Synthetic Peptide encoding a CDR
WAST

SEQ ID NO: 13573 - protein, 4 aa, Artificial Sequence
  Synthetic Peptide encoding a CDR
KVSN

SEQ ID NO: 13574 - protein, 4 aa, Artificial Sequence
  Synthetic Peptide encoding a CDR
AASS

SEQ ID NO: 13575 - protein, 4 aa, Artificial Sequence
  Synthetic Peptide encoding a CDR
HASS

SEQ ID NO: 13576 - protein, 4 aa, Artificial Sequence
  Synthetic Peptide encoding a CDR
RASN

SEQ ID NO: 13577 - protein, 4 aa, Artificial Sequence
  Synthetic Peptide encoding a CDR
DAST

SEQ ID NO: 13578 - protein, 4 aa, Artificial Sequence
  Synthetic Peptide encoding a CDR
KVSN

SEQ ID NO: 13579 - protein, 4 aa, Artificial Sequence
  Synthetic Peptide encoding a CDR
SASN

SEQ ID NO: 13580 - protein, 4 aa, Artificial Sequence
  Synthetic Peptide encoding a CDR
YSSN

SEQ ID NO: 13581 - protein, 7 aa, Artificial Sequence
  Synthetic Peptide encoding a CDR
VKSDGSY

SEQ ID NO: 13582 - protein, 7 aa, Artificial Sequence
  Synthetic Peptide encoding a CDR
VKSDGSY

SEQ ID NO: 13583 - protein, 7 aa, Artificial Sequence
  Synthetic Peptide encoding a CDR
VKSDGSY

SEQ ID NO: 13584 - protein, 4 aa, Artificial Sequence
  Synthetic Peptide encoding a CDR
AASS

SEQ ID NO: 13585 - protein, 4 aa, Artificial Sequence
  Synthetic Peptide encoding a CDR
AASS

SEQ ID NO: 13586 - protein, 4 aa, Artificial Sequence
  Synthetic Peptide encoding a CDR
EDNQ

SEQ ID NO: 13587 - protein, 4 aa, Artificial Sequence
  Synthetic Peptide encoding a CDR
DTSN

SEQ ID NO: 13588 - protein, 4 aa, Artificial Sequence
  Synthetic Peptide encoding a CDR
KVSN

SEQ ID NO: 13589 - protein, 4 aa, Artificial Sequence
  Synthetic Peptide encoding a CDR
AASS

SEQ ID NO: 13590 - protein, 4 aa, Artificial Sequence
  Synthetic Peptide encoding a CDR
DNDR

SEQ ID NO: 13591 - protein, 4 aa, Artificial Sequence
  Synthetic Peptide encoding a CDR
RSNQ

SEQ ID NO: 13592 - protein, 4 aa, Artificial Sequence
  Synthetic Peptide encoding a CDR
SASF

SEQ ID NO: 13593 - protein, 4 aa, Artificial Sequence
  Synthetic Peptide encoding a CDR
FDSD

SEQ ID NO: 13594 - protein, 4 aa, Artificial Sequence
  Synthetic Peptide encoding a CDR
DGSK

SEQ ID NO: 13595 - protein, 4 aa, Artificial Sequence
  Synthetic Peptide encoding a CDR
DVNK

SEQ ID NO: 13596 - protein, 4 aa, Artificial Sequence
  Synthetic Peptide encoding a CDR
SGST

SEQ ID NO: 13597 - protein, 4 aa, Artificial Sequence
  Synthetic Peptide encoding a CDR
GAST

SEQ ID NO: 13598 - protein, 4 aa, Artificial Sequence
  Synthetic Peptide encoding a CDR
SASY

SEQ ID NO: 13599 - protein, 4 aa, Artificial Sequence
  Synthetic Peptide encoding a CDR
DASH

SEQ ID NO: 13600 - protein, 4 aa, Artificial Sequence
  Synthetic Peptide encoding a CDR
LGSN

SEQ ID NO: 13601 - protein, 4 aa, Artificial Sequence
  Synthetic Peptide encoding a CDR
DASN

SEQ ID NO: 13602 - protein, 4 aa, Artificial Sequence
  Synthetic Peptide encoding a CDR
STSN

SEQ ID NO: 13603 - protein, 4 aa, Artificial Sequence
  Synthetic Peptide encoding a CDR
SASY

SEQ ID NO: 13604 - protein, 4 aa, Artificial Sequence
  Synthetic Peptide encoding a CDR
YGSE

SEQ ID NO: 13605 - protein, 4 aa, Artificial Sequence
  Synthetic Peptide encoding a CDR
AASS

SEQ ID NO: 13606 - protein, 4 aa, Artificial Sequence
  Synthetic Peptide encoding a CDR
GATS

SEQ ID NO: 13607 - protein, 4 aa, Artificial Sequence
  Synthetic Peptide encoding a CDR
FAST

SEQ ID NO: 13608 - protein, 4 aa, Artificial Sequence
  Synthetic Peptide encoding a CDR
YTSR

SEQ ID NO: 13609 - protein, 4 aa, Artificial Sequence
  Synthetic Peptide encoding a CDR
DTST

SEQ ID NO: 13610 - protein, 4 aa, Artificial Sequence
  Synthetic Peptide encoding a CDR
NAKT

SEQ ID NO: 13611 - protein, 4 aa, Artificial Sequence
  Synthetic Peptide encoding a CDR
KVSN

SEQ ID NO: 13612 - protein, 4 aa, Artificial Sequence
  Synthetic Peptide encoding a CDR
NAKI

SEQ ID NO: 13613 - protein, 4 aa, Artificial Sequence
  Synthetic Peptide encoding a CDR
SASY

SEQ ID NO: 13614 - protein, 4 aa, Artificial Sequence
  Synthetic Peptide encoding a CDR
GNSN

SEQ ID NO: 13615 - protein, 4 aa, Artificial Sequence
  Synthetic Peptide encoding a CDR
EDDK

SEQ ID NO: 13616 - protein, 4 aa, Artificial Sequence
  Synthetic Peptide encoding a CDR
AASS

SEQ ID NO: 13617 - protein, 4 aa, Artificial Sequence
  Synthetic Peptide encoding a CDR
AATS

SEQ ID NO: 13618 - protein, 4 aa, Artificial Sequence
  Synthetic Peptide encoding a CDR
AATS

SEQ ID NO: 13619 - protein, 4 aa, Artificial Sequence
  Synthetic Peptide encoding a CDR
AATS

SEQ ID NO: 13620 - protein, 4 aa, Artificial Sequence
  Synthetic Peptide encoding a CDR
RTSN

SEQ ID NO: 13621 - protein, 4 aa, Artificial Sequence
  Synthetic Peptide encoding a CDR
RMSN

SEQ ID NO: 13622 - protein, 4 aa, Artificial Sequence
  Synthetic Peptide encoding a CDR
RMSN

SEQ ID NO: 13623 - protein, 4 aa, Artificial Sequence
  Synthetic Peptide encoding a CDR
EGSK

SEQ ID NO: 13624 - protein, 4 aa, Artificial Sequence
  Synthetic Peptide encoding a CDR
GASN

SEQ ID NO: 13625 - protein, 4 aa, Artificial Sequence
  Synthetic Peptide encoding a CDR
GASS

SEQ ID NO: 13626 - protein, 4 aa, Artificial Sequence
  Synthetic Peptide encoding a CDR
DASN

SEQ ID NO: 13627 - protein, 4 aa, Artificial Sequence
  Synthetic Peptide encoding a CDR
WAST

SEQ ID NO: 13628 - protein, 4 aa, Artificial Sequence
  Synthetic Peptide encoding a CDR
GASS

SEQ ID NO: 13629 - protein, 4 aa, Artificial Sequence
  Synthetic Peptide encoding a CDR
LVSK

SEQ ID NO: 13630 - protein, 4 aa, Artificial Sequence
  Synthetic Peptide encoding a CDR
DVIE

SEQ ID NO: 13631 - protein, 4 aa, Artificial Sequence
  Synthetic Peptide encoding a CDR
DASN

SEQ ID NO: 13632 - protein, 4 aa, Artificial Sequence
  Synthetic Peptide encoding a CDR
DASN

SEQ ID NO: 13633 - protein, 4 aa, Artificial Sequence
  Synthetic Peptide encoding a CDR
AASS

SEQ ID NO: 13634 - protein, 4 aa, Artificial Sequence
  Synthetic Peptide encoding a CDR
SASF

SEQ ID NO: 13635 - protein, 4 aa, Artificial Sequence
  Synthetic Peptide encoding a CDR
LASG

SEQ ID NO: 13636 - protein, 4 aa, Artificial Sequence
  Synthetic Peptide encoding a CDR
LVSN

SEQ ID NO: 13637 - protein, 4 aa, Artificial Sequence
  Synthetic Peptide encoding a CDR
TASS

SEQ ID NO: 13638 - protein, 4 aa, Artificial Sequence
  Synthetic Peptide encoding a CDR
LGSI

SEQ ID NO: 13639 - protein, 4 aa, Artificial Sequence
  Synthetic Peptide encoding a CDR
EAST

SEQ ID NO: 13640 - protein, 4 aa, Artificial Sequence
  Synthetic Peptide encoding a CDR
WAST

SEQ ID NO: 13641 - protein, 4 aa, Artificial Sequence
  Synthetic Peptide encoding a CDR
RTNR

SEQ ID NO: 13642 - protein, 4 aa, Artificial Sequence
  Synthetic Peptide encoding a CDR
SASY

SEQ ID NO: 13643 - protein, 4 aa, Artificial Sequence
  Synthetic Peptide encoding a CDR
RANR

SEQ ID NO: 13644 - protein, 4 aa, Artificial Sequence
  Synthetic Peptide encoding a CDR
HLSC

SEQ ID NO: 13645 - protein, 4 aa, Artificial Sequence
  Synthetic Peptide encoding a CDR
RNNQ

SEQ ID NO: 13646 - protein, 4 aa, Artificial Sequence
  Synthetic Peptide encoding a CDR
GAST

SEQ ID NO: 13647 - protein, 4 aa, Artificial Sequence
  Synthetic Peptide encoding a CDR
DTSK

SEQ ID NO: 13648 - protein, 4 aa, Artificial Sequence
  Synthetic Peptide encoding a CDR
DASN

SEQ ID NO: 13649 - protein, 4 aa, Artificial Sequence
  Synthetic Peptide encoding a CDR
RVSN

SEQ ID NO: 13650 - protein, 4 aa, Artificial Sequence
  Synthetic Peptide encoding a CDR
QDRK

SEQ ID NO: 13651 - protein, 4 aa, Artificial Sequence
  Synthetic Peptide encoding a CDR
EDNQ

SEQ ID NO: 13652 - protein, 4 aa, Artificial Sequence
  Synthetic Peptide encoding a CDR
KASN

SEQ ID NO: 13653 - protein, 4 aa, Artificial Sequence
  Synthetic Peptide encoding a CDR
GASS

SEQ ID NO: 13654 - protein, 4 aa, Artificial Sequence
  Synthetic Peptide encoding a CDR
GAST

SEQ ID NO: 13655 - protein, 4 aa, Artificial Sequence
  Synthetic Peptide encoding a CDR
DASN

SEQ ID NO: 13656 - protein, 4 aa, Artificial Sequence
  Synthetic Peptide encoding a CDR
TLSY

SEQ ID NO: 13657 - protein, 4 aa, Artificial Sequence
  Synthetic Peptide encoding a CDR
YATE

SEQ ID NO: 13658 - protein, 4 aa, Artificial Sequence
  Synthetic Peptide encoding a CDR
YASE

SEQ ID NO: 13659 - protein, 4 aa, Artificial Sequence
  Synthetic Peptide encoding a CDR
WAST

SEQ ID NO: 13660 - protein, 4 aa, Artificial Sequence
  Synthetic Peptide encoding a CDR
SASY

SEQ ID NO: 13661 - protein, 4 aa, Artificial Sequence
  Synthetic Peptide encoding a CDR
LASN

SEQ ID NO: 13662 - protein, 4 aa, Artificial Sequence
  Synthetic Peptide encoding a CDR
AASS

SEQ ID NO: 13663 - protein, 4 aa, Artificial Sequence
  Synthetic Peptide encoding a CDR
QDSK

SEQ ID NO: 13664 - protein, 4 aa, Artificial Sequence
  Synthetic Peptide encoding a CDR
SASN

SEQ ID NO: 13665 - protein, 4 aa, Artificial Sequence
  Synthetic Peptide encoding a CDR
FASR

SEQ ID NO: 13666 - protein, 4 aa, Artificial Sequence
  Synthetic Peptide encoding a CDR
LGSN

SEQ ID NO: 13667 - protein, 4 aa, Artificial Sequence
  Synthetic Peptide encoding a CDR
LGSN

SEQ ID NO: 13668 - protein, 4 aa, Artificial Sequence
  Synthetic Peptide encoding a CDR
GSNR

SEQ ID NO: 13669 - protein, 4 aa, Artificial Sequence
  Synthetic Peptide encoding a CDR
AAST

SEQ ID NO: 13670 - protein, 4 aa, Artificial Sequence
  Synthetic Peptide encoding a CDR
SNNQ

SEQ ID NO: 13671 - protein, 4 aa, Artificial Sequence
  Synthetic Peptide encoding a CDR
KASS

SEQ ID NO: 13672 - protein, 4 aa, Artificial Sequence
  Synthetic Peptide encoding a CDR
RSNQ

SEQ ID NO: 13673 - protein, 4 aa, Artificial Sequence
  Synthetic Peptide encoding a CDR
DDSD

SEQ ID NO: 13674 - protein, 4 aa, Artificial Sequence
  Synthetic Peptide encoding a CDR
GTNN

SEQ ID NO: 13675 - protein, 4 aa, Artificial Sequence
  Synthetic Peptide encoding a CDR
RASN

SEQ ID NO: 13676 - protein, 4 aa, Artificial Sequence
  Synthetic Peptide encoding a CDR
GASS

SEQ ID NO: 13677 - protein, 4 aa, Artificial Sequence
  Synthetic Peptide encoding a CDR
GQNN

SEQ ID NO: 13678 - protein, 4 aa, Artificial Sequence
  Synthetic Peptide encoding a CDR
NASQ

SEQ ID NO: 13679 - protein, 4 aa, Artificial Sequence
  Synthetic Peptide encoding a CDR
DTSK

SEQ ID NO: 13680 - protein, 4 aa, Artificial Sequence
  Synthetic Peptide encoding a CDR
DTSK

SEQ ID NO: 13681 - protein, 4 aa, Artificial Sequence
  Synthetic Peptide encoding a CDR
YTST

SEQ ID NO: 13682 - protein, 4 aa, Artificial Sequence
  Synthetic Peptide encoding a CDR
AASY

SEQ ID NO: 13683 - protein, 4 aa, Artificial Sequence
  Synthetic Peptide encoding a CDR
VASS

SEQ ID NO: 13684 - protein, 4 aa, Artificial Sequence
  Synthetic Peptide encoding a CDR
GAST

SEQ ID NO: 13685 - protein, 4 aa, Artificial Sequence
  Synthetic Peptide encoding a CDR
GAST

SEQ ID NO: 13686 - protein, 4 aa, Artificial Sequence
  Synthetic Peptide encoding a CDR
SGST

SEQ ID NO: 13687 - protein, 4 aa, Artificial Sequence
  Synthetic Peptide encoding a CDR
DVNN

SEQ ID NO: 13688 - protein, 4 aa, Artificial Sequence
  Synthetic Peptide encoding a CDR
DNNK

SEQ ID NO: 13689 - protein, 4 aa, Artificial Sequence
  Synthetic Peptide encoding a CDR
GNSN

SEQ ID NO: 13690 - protein, 4 aa, Artificial Sequence
  Synthetic Peptide encoding a CDR
SNNQ

SEQ ID NO: 13691 - protein, 4 aa, Artificial Sequence
  Synthetic Peptide encoding a CDR
LASN

SEQ ID NO: 13692 - protein, 4 aa, Artificial Sequence
  Synthetic Peptide encoding a CDR
LASN

SEQ ID NO: 13693 - protein, 4 aa, Artificial Sequence
  Synthetic Peptide encoding a CDR
WAST

SEQ ID NO: 13694 - protein, 4 aa, Artificial Sequence
  Synthetic Peptide encoding a CDR
WAST

SEQ ID NO: 13695 - protein, 4 aa, Artificial Sequence
  Synthetic Peptide encoding a CDR
GASS

SEQ ID NO: 13696 - protein, 4 aa, Artificial Sequence
  Synthetic Peptide encoding a CDR
RDDK

SEQ ID NO: 13697 - protein, 4 aa, Artificial Sequence
  Synthetic Peptide encoding a CDR
DASN

SEQ ID NO: 13698 - protein, 4 aa, Artificial Sequence
  Synthetic Peptide encoding a CDR
DASN

SEQ ID NO: 13699 - protein, 4 aa, Artificial Sequence
  Synthetic Peptide encoding a CDR
SGSG

SEQ ID NO: 13700 - protein, 4 aa, Artificial Sequence
  Synthetic Peptide encoding a CDR
DASN

SEQ ID NO: 13701 - protein, 4 aa, Artificial Sequence
  Synthetic Peptide encoding a CDR
ETSK

SEQ ID NO: 13702 - protein, 4 aa, Artificial Sequence
  Synthetic Peptide encoding a CDR
WAST

SEQ ID NO: 13703 - protein, 4 aa, Artificial Sequence
  Synthetic Peptide encoding a CDR
RVSN

SEQ ID NO: 13704 - protein, 4 aa, Artificial Sequence
  Synthetic Peptide encoding a CDR
AASN

SEQ ID NO: 13705 - protein, 4 aa, Artificial Sequence
  Synthetic Peptide encoding a CDR
AWYS

SEQ ID NO: 13706 - protein, 4 aa, Artificial Sequence
  Synthetic Peptide encoding a CDR
RMSN

SEQ ID NO: 13707 - protein, 4 aa, Artificial Sequence
  Synthetic Peptide encoding a CDR
DASN

SEQ ID NO: 13708 - protein, 4 aa, Artificial Sequence
  Synthetic Peptide encoding a CDR
AASN

SEQ ID NO: 13709 - protein, 4 aa, Artificial Sequence
  Synthetic Peptide encoding a CDR
SATY

SEQ ID NO: 13710 - protein, 4 aa, Artificial Sequence
  Synthetic Peptide encoding a CDR
DTDK

SEQ ID NO: 13711 - protein, 4 aa, Artificial Sequence
  Synthetic Peptide encoding a CDR
GATT

SEQ ID NO: 13712 - protein, 4 aa, Artificial Sequence
  Synthetic Peptide encoding a CDR
DASN

SEQ ID NO: 13713 - protein, 4 aa, Artificial Sequence
  Synthetic Peptide encoding a CDR
ATSN

SEQ ID NO: 13714 - protein, 4 aa, Artificial Sequence
  Synthetic Peptide encoding a CDR
DASN

SEQ ID NO: 13715 - protein, 4 aa, Artificial Sequence
  Synthetic Peptide encoding a CDR
DASN

SEQ ID NO: 13716 - protein, 4 aa, Artificial Sequence
  Synthetic Peptide encoding a CDR
APSN

SEQ ID NO: 13717 - protein, 4 aa, Artificial Sequence
  Synthetic Peptide encoding a CDR
ATSN

SEQ ID NO: 13718 - protein, 4 aa, Artificial Sequence
  Synthetic Peptide encoding a CDR
FASN

SEQ ID NO: 13719 - protein, 4 aa, Artificial Sequence
  Synthetic Peptide encoding a CDR
ATSN

SEQ ID NO: 13720 - protein, 4 aa, Artificial Sequence
  Synthetic Peptide encoding a CDR
ATSN

SEQ ID NO: 13721 - protein, 4 aa, Artificial Sequence
  Synthetic Peptide encoding a CDR
DASN

SEQ ID NO: 13722 - protein, 4 aa, Artificial Sequence
  Synthetic Peptide encoding a CDR
ATSA

SEQ ID NO: 13723 - protein, 4 aa, Artificial Sequence
  Synthetic Peptide encoding a CDR
DASS

SEQ ID NO: 13724 - protein, 4 aa, Artificial Sequence
  Synthetic Peptide encoding a CDR
YTST

SEQ ID NO: 13725 - protein, 4 aa, Artificial Sequence
  Synthetic Peptide encoding a CDR
RANR

SEQ ID NO: 13726 - protein, 4 aa, Artificial Sequence
  Synthetic Peptide encoding a CDR
LGVN

SEQ ID NO: 13727 - protein, 4 aa, Artificial Sequence
  Synthetic Peptide encoding a CDR
LASN

SEQ ID NO: 13728 - protein, 4 aa, Artificial Sequence
  Synthetic Peptide encoding a CDR
AASS

SEQ ID NO: 13729 - protein, 4 aa, Artificial Sequence
  Synthetic Peptide encoding a CDR
LVSK

SEQ ID NO: 13730 - protein, 4 aa, Artificial Sequence
  Synthetic Peptide encoding a CDR
SPSY

SEQ ID NO: 13731 - protein, 4 aa, Artificial Sequence
  Synthetic Peptide encoding a CDR
YASN

SEQ ID NO: 13732 - protein, 4 aa, Artificial Sequence
  Synthetic Peptide encoding a CDR
STSN

SEQ ID NO: 13733 - protein, 4 aa, Artificial Sequence
  Synthetic Peptide encoding a CDR
STSN

SEQ ID NO: 13734 - protein, 4 aa, Artificial Sequence
  Synthetic Peptide encoding a CDR
SASY

SEQ ID NO: 13735 - protein, 4 aa, Artificial Sequence
  Synthetic Peptide encoding a CDR
KVSN

SEQ ID NO: 13736 - protein, 4 aa, Artificial Sequence
  Synthetic Peptide encoding a CDR
KVSN

SEQ ID NO: 13737 - protein, 4 aa, Artificial Sequence
  Synthetic Peptide encoding a CDR
KVSN

SEQ ID NO: 13738 - protein, 4 aa, Artificial Sequence
  Synthetic Peptide encoding a CDR
GATS

SEQ ID NO: 13739 - protein, 4 aa, Artificial Sequence
  Synthetic Peptide encoding a CDR
SASY

SEQ ID NO: 13740 - protein, 4 aa, Artificial Sequence
  Synthetic Peptide encoding a CDR
KVSN

SEQ ID NO: 13741 - protein, 4 aa, Artificial Sequence
  Synthetic Peptide encoding a CDR
DVSK

SEQ ID NO: 13742 - protein, 4 aa, Artificial Sequence
  Synthetic Peptide encoding a CDR
GNSN

SEQ ID NO: 13743 - protein, 4 aa, Artificial Sequence
  Synthetic Peptide encoding a CDR
DVSK

SEQ ID NO: 13744 - protein, 4 aa, Artificial Sequence
  Synthetic Peptide encoding a CDR
DASN

SEQ ID NO: 13745 - protein, 4 aa, Artificial Sequence
  Synthetic Peptide encoding a CDR
NNNQ

SEQ ID NO: 13746 - protein, 4 aa, Artificial Sequence
  Synthetic Peptide encoding a CDR
YDSD

SEQ ID NO: 13747 - protein, 4 aa, Artificial Sequence
  Synthetic Peptide encoding a CDR
AASS

SEQ ID NO: 13748 - protein, 4 aa, Artificial Sequence
  Synthetic Peptide encoding a CDR
WAST

SEQ ID NO: 13749 - protein, 4 aa, Artificial Sequence
  Synthetic Peptide encoding a CDR
KVSN

SEQ ID NO: 13750 - protein, 4 aa, Artificial Sequence
  Synthetic Peptide encoding a CDR
DASN

SEQ ID NO: 13751 - protein, 4 aa, Artificial Sequence
  Synthetic Peptide encoding a CDR
AASS

SEQ ID NO: 13752 - protein, 4 aa, Artificial Sequence
  Synthetic Peptide encoding a CDR
DDSD

SEQ ID NO: 13753 - protein, 4 aa, Artificial Sequence
  Synthetic Peptide encoding a CDR
GNSN

SEQ ID NO: 13754 - protein, 4 aa, Artificial Sequence
  Synthetic Peptide encoding a CDR
EDNK

SEQ ID NO: 13755 - protein, 4 aa, Artificial Sequence
  Synthetic Peptide encoding a CDR
STSN

SEQ ID NO: 13756 - protein, 4 aa, Artificial Sequence
  Synthetic Peptide encoding a CDR
WAST

SEQ ID NO: 13757 - protein, 4 aa, Artificial Sequence
  Synthetic Peptide encoding a CDR
NTSR

SEQ ID NO: 13758 - protein, 4 aa, Artificial Sequence
  Synthetic Peptide encoding a CDR
FAST

SEQ ID NO: 13759 - protein, 4 aa, Artificial Sequence
  Synthetic Peptide encoding a CDR
DNNK

SEQ ID NO: 13760 - protein, 4 aa, Artificial Sequence
  Synthetic Peptide encoding a CDR
KVSN

SEQ ID NO: 13761 - protein, 4 aa, Artificial Sequence
  Synthetic Peptide encoding a CDR
RASN

SEQ ID NO: 13762 - protein, 4 aa, Artificial Sequence
  Synthetic Peptide encoding a CDR
LASN

SEQ ID NO: 13763 - protein, 4 aa, Artificial Sequence
  Synthetic Peptide encoding a CDR
LASN

SEQ ID NO: 13764 - protein, 4 aa, Artificial Sequence
  Synthetic Peptide encoding a CDR
AATD

SEQ ID NO: 13765 - protein, 4 aa, Artificial Sequence
  Synthetic Peptide encoding a CDR
KISN

SEQ ID NO: 13766 - protein, 4 aa, Artificial Sequence
  Synthetic Peptide encoding a CDR
GKNN

SEQ ID NO: 13767 - protein, 4 aa, Artificial Sequence
  Synthetic Peptide encoding a CDR
DVSN

SEQ ID NO: 13768 - protein, 4 aa, Artificial Sequence
  Synthetic Peptide encoding a CDR
DADK

SEQ ID NO: 13769 - protein, 4 aa, Artificial Sequence
  Synthetic Peptide encoding a CDR
EVNN

SEQ ID NO: 13770 - protein, 4 aa, Artificial Sequence
  Synthetic Peptide encoding a CDR
DVSN

SEQ ID NO: 13771 - protein, 4 aa, Artificial Sequence
  Synthetic Peptide encoding a CDR
HTSR

SEQ ID NO: 13772 - protein, 4 aa, Artificial Sequence
  Synthetic Peptide encoding a CDR
RTSN

SEQ ID NO: 13773 - protein, 4 aa, Artificial Sequence
  Synthetic Peptide encoding a CDR
AATS

SEQ ID NO: 13774 - protein, 4 aa, Artificial Sequence
  Synthetic Peptide encoding a CDR
AASN

SEQ ID NO: 13775 - protein, 4 aa, Artificial Sequence
  Synthetic Peptide encoding a CDR
AAST

SEQ ID NO: 13776 - protein, 4 aa, Artificial Sequence
  Synthetic Peptide encoding a CDR
FAKT

SEQ ID NO: 13777 - protein, 4 aa, Artificial Sequence
  Synthetic Peptide encoding a CDR
FAKT

SEQ ID NO: 13778 - protein, 4 aa, Artificial Sequence
  Synthetic Peptide encoding a CDR
GASS

SEQ ID NO: 13779 - protein, 4 aa, Artificial Sequence
  Synthetic Peptide encoding a CDR
GASS

SEQ ID NO: 13780 - protein, 4 aa, Artificial Sequence
  Synthetic Peptide encoding a CDR
GASS

SEQ ID NO: 13781 - protein, 4 aa, Artificial Sequence
  Synthetic Peptide encoding a CDR
GASS

SEQ ID NO: 13782 - protein, 4 aa, Artificial Sequence
  Synthetic Peptide encoding a CDR
DASN

SEQ ID NO: 13783 - protein, 4 aa, Artificial Sequence
  Synthetic Peptide encoding a CDR
DASN

SEQ ID NO: 13784 - protein, 4 aa, Artificial Sequence
  Synthetic Peptide encoding a CDR
DASS

SEQ ID NO: 13785 - protein, 4 aa, Artificial Sequence
  Synthetic Peptide encoding a CDR
GASS

SEQ ID NO: 13786 - protein, 4 aa, Artificial Sequence
  Synthetic Peptide encoding a CDR
GASS

SEQ ID NO: 13787 - protein, 4 aa, Artificial Sequence
  Synthetic Peptide encoding a CDR
FNKR

SEQ ID NO: 13788 - protein, 4 aa, Artificial Sequence
  Synthetic Peptide encoding a CDR
FNKR

SEQ ID NO: 13789 - protein, 4 aa, Artificial Sequence
  Synthetic Peptide encoding a CDR
FDKR

SEQ ID NO: 13790 - protein, 4 aa, Artificial Sequence
  Synthetic Peptide encoding a CDR
KSSI

SEQ ID NO: 13791 - protein, 4 aa, Artificial Sequence
  Synthetic Peptide encoding a CDR
KSSI

SEQ ID NO: 13792 - protein, 4 aa, Artificial Sequence
  Synthetic Peptide encoding a CDR
FDDD

SEQ ID NO: 13793 - protein, 4 aa, Artificial Sequence
  Synthetic Peptide encoding a CDR
KTST

SEQ ID NO: 13794 - protein, 4 aa, Artificial Sequence
  Synthetic Peptide encoding a CDR
KTST

SEQ ID NO: 13795 - protein, 4 aa, Artificial Sequence
  Synthetic Peptide encoding a CDR
GVST

SEQ ID NO: 13796 - protein, 4 aa, Artificial Sequence
  Synthetic Peptide encoding a CDR
GVST

SEQ ID NO: 13797 - protein, 4 aa, Artificial Sequence
  Synthetic Peptide encoding a CDR
GTSS

SEQ ID NO: 13798 - protein, 4 aa, Artificial Sequence
  Synthetic Peptide encoding a CDR
GASS

SEQ ID NO: 13799 - protein, 4 aa, Artificial Sequence
  Synthetic Peptide encoding a CDR
GASS

SEQ ID NO: 13800 - protein, 4 aa, Artificial Sequence
  Synthetic Peptide encoding a CDR
GASS

SEQ ID NO: 13801 - protein, 4 aa, Artificial Sequence
  Synthetic Peptide encoding a CDR
GASS

SEQ ID NO: 13802 - protein, 4 aa, Artificial Sequence
  Synthetic Peptide encoding a CDR
GASS

SEQ ID NO: 13803 - protein, 4 aa, Artificial Sequence
  Synthetic Peptide encoding a CDR
GASR

SEQ ID NO: 13804 - protein, 4 aa, Artificial Sequence
  Synthetic Peptide encoding a CDR
ENDR

SEQ ID NO: 13805 - protein, 4 aa, Artificial Sequence
  Synthetic Peptide encoding a CDR
ENDR

SEQ ID NO: 13806 - protein, 4 aa, Artificial Sequence
  Synthetic Peptide encoding a CDR
NAKI

SEQ ID NO: 13807 - protein, 4 aa, Artificial Sequence
  Synthetic Peptide encoding a CDR
SASY

SEQ ID NO: 13808 - protein, 4 aa, Artificial Sequence
  Synthetic Peptide encoding a CDR
LASN

SEQ ID NO: 13809 - protein, 4 aa, Artificial Sequence
  Synthetic Peptide encoding a CDR
LASN

SEQ ID NO: 13810 - protein, 4 aa, Artificial Sequence
  Synthetic Peptide encoding a CDR
LASN

SEQ ID NO: 13811 - protein, 4 aa, Artificial Sequence
  Synthetic Peptide encoding a CDR
LASN

SEQ ID NO: 13812 - protein, 4 aa, Artificial Sequence
  Synthetic Peptide encoding a CDR
LASN

SEQ ID NO: 13813 - protein, 4 aa, Artificial Sequence
  Synthetic Peptide encoding a CDR
LASN

SEQ ID NO: 13814 - protein, 4 aa, Artificial Sequence
  Synthetic Peptide encoding a CDR
LASN

SEQ ID NO: 13815 - protein, 4 aa, Artificial Sequence
  Synthetic Peptide encoding a CDR
LHSG

SEQ ID NO: 13816 - protein, 9 aa, Artificial Sequence
  Synthetic Peptide encoding a CDR
QQNNKDPPT

SEQ ID NO: 13817 - protein, 9 aa, Artificial Sequence
  Synthetic Peptide encoding a CDR
QQGSALPPT

SEQ ID NO: 13818 - protein, 9 aa, Artificial Sequence
  Synthetic Peptide encoding a CDR
FQGSHVPPT

SEQ ID NO: 13819 - protein, 11 aa, Artificial Sequence
  Synthetic Peptide encoding a CDR
QSYDSSLSGYV

SEQ ID NO: 13820 - protein, 11 aa, Artificial Sequence
  Synthetic Peptide encoding a CDR
AAWDDSLNGYV

SEQ ID NO: 13821 - protein, 9 aa, Artificial Sequence
  Synthetic Peptide encoding a CDR
LQSRTIPRT

SEQ ID NO: 13822 - protein, 9 aa, Artificial Sequence
  Synthetic Peptide encoding a CDR
QQYRKLPWT

SEQ ID NO: 13823 - protein, 8 aa, Artificial Sequence
  Synthetic Peptide encoding a CDR
HQYISSYT

SEQ ID NO: 13824 - protein, 9 aa, Artificial Sequence
  Synthetic Peptide encoding a CDR
QNDYSYPYT

SEQ ID NO: 13825 - protein, 9 aa, Artificial Sequence
  Synthetic Peptide encoding a CDR
QQYSKLPRT

SEQ ID NO: 13826 - protein, 8 aa, Artificial Sequence
  Synthetic Peptide encoding a CDR
QHFWGTWT

SEQ ID NO: 13827 - protein, 9 aa, Artificial Sequence
  Synthetic Peptide encoding a CDR
MQHLEYPFT

SEQ ID NO: 13828 - protein, 9 aa, Artificial Sequence
  Synthetic Peptide encoding a CDR
FQGSVYPFT

SEQ ID NO: 13829 - protein, 9 aa, Artificial Sequence
  Synthetic Peptide encoding a CDR
QQSTEDPWT

SEQ ID NO: 13830 - protein, 9 aa, Artificial Sequence
  Synthetic Peptide encoding a CDR
QQGNTLPYT

SEQ ID NO: 13831 - protein, 9 aa, Artificial Sequence
  Synthetic Peptide encoding a CDR
QQGNTLPYT

SEQ ID NO: 13832 - protein, 9 aa, Artificial Sequence
  Synthetic Peptide encoding a CDR
QQGNTLPYT

SEQ ID NO: 13833 - protein, 9 aa, Artificial Sequence
  Synthetic Peptide encoding a CDR
QQGNTLPYT

SEQ ID NO: 13834 - protein, 9 aa, Artificial Sequence
  Synthetic Peptide encoding a CDR
QQRSNWPIT

SEQ ID NO: 13835 - protein, 9 aa, Artificial Sequence
  Synthetic Peptide encoding a CDR
AQNLELPYT

SEQ ID NO: 13836 - protein, 9 aa, Artificial Sequence
  Synthetic Peptide encoding a CDR
FQGSQFPYT

SEQ ID NO: 13837 - protein, 9 aa, Artificial Sequence
  Synthetic Peptide encoding a CDR
QQDYRSPWT

SEQ ID NO: 13838 - protein, 9 aa, Artificial Sequence
  Synthetic Peptide encoding a CDR
QQSYSIPQI

SEQ ID NO: 13839 - protein, 11 aa, Artificial Sequence
  Synthetic Peptide encoding a CDR
QQRNNWPPMYT

SEQ ID NO: 13840 - protein, 9 aa, Artificial Sequence
  Synthetic Peptide encoding a CDR
QQYDSYPIT

SEQ ID NO: 13841 - protein, 9 aa, Artificial Sequence
  Synthetic Peptide encoding a CDR
QQSNEDPWT

SEQ ID NO: 13842 - protein, 9 aa, Artificial Sequence
  Synthetic Peptide encoding a CDR
QQYNSYPPT

SEQ ID NO: 13843 - protein, 9 aa, Artificial Sequence
  Synthetic Peptide encoding a CDR
FQGSHAPWT

SEQ ID NO: 13844 - protein, 9 aa, Artificial Sequence
  Synthetic Peptide encoding a CDR
QQWSSHPFT

SEQ ID NO: 13845 - protein, 8 aa, Artificial Sequence
  Synthetic Peptide encoding a CDR
HQYLSSRT

SEQ ID NO: 13846 - protein, 9 aa, Artificial Sequence
  Synthetic Peptide encoding a CDR
QQSAHFPIT

SEQ ID NO: 13847 - protein, 9 aa, Artificial Sequence
  Synthetic Peptide encoding a CDR
FQGSHVPRT

SEQ ID NO: 13848 - protein, 9 aa, Artificial Sequence
  Synthetic Peptide encoding a CDR
FQGSHVPRT

SEQ ID NO: 13849 - protein, 9 aa, Artificial Sequence
  Synthetic Peptide encoding a CDR
LQWSSNPLT

SEQ ID NO: 13850 - protein, 9 aa, Artificial Sequence
  Synthetic Peptide encoding a CDR
QQGNSLPFT

SEQ ID NO: 13851 - protein, 9 aa, Artificial Sequence
  Synthetic Peptide encoding a CDR
QQGNSLPFT

SEQ ID NO: 13852 - protein, 9 aa, Artificial Sequence
  Synthetic Peptide encoding a CDR
WQGTHFPYT

SEQ ID NO: 13853 - protein, 9 aa, Artificial Sequence
  Synthetic Peptide encoding a CDR
QQSNEDPLT

SEQ ID NO: 13854 - protein, 9 aa, Artificial Sequence
  Synthetic Peptide encoding a CDR
QQYYSYPWT

SEQ ID NO: 13855 - protein, 9 aa, Artificial Sequence
  Synthetic Peptide encoding a CDR
QQYYSYPWT

SEQ ID NO: 13856 - protein, 9 aa, Artificial Sequence
  Synthetic Peptide encoding a CDR
QQYGSSPFT

SEQ ID NO: 13857 - protein, 9 aa, Artificial Sequence
  Synthetic Peptide encoding a CDR
QQYYTSPYT

SEQ ID NO: 13858 - protein, 10 aa, Artificial Sequence
  Synthetic Peptide encoding a CDR
QQSGTFPPTT

SEQ ID NO: 13859 - protein, 7 aa, Artificial Sequence
  Synthetic Peptide encoding a CDR
KQSNLYT

SEQ ID NO: 13860 - protein, 8 aa, Artificial Sequence
  Synthetic Peptide encoding a CDR
KQSYNLYT

SEQ ID NO: 13861 - protein, 9 aa, Artificial Sequence
  Synthetic Peptide encoding a CDR
LQYAIYPYT

SEQ ID NO: 13862 - protein, 9 aa, Artificial Sequence
  Synthetic Peptide encoding a CDR
QQNNYDPWT

SEQ ID NO: 13863 - protein, 11 aa, Artificial Sequence
  Synthetic Peptide encoding a CDR
QSYDDSNHISV

SEQ ID NO: 13864 - protein, 9 aa, Artificial Sequence
  Synthetic Peptide encoding a CDR
QQYSSYPYT

SEQ ID NO: 13865 - protein, 9 aa, Artificial Sequence
  Synthetic Peptide encoding a CDR
QQYSSYPYT

SEQ ID NO: 13866 - protein, 9 aa, Artificial Sequence
  Synthetic Peptide encoding a CDR
QQYSSYPYT

SEQ ID NO: 13867 - protein, 9 aa, Artificial Sequence
  Synthetic Peptide encoding a CDR
QQHYSTPLT

SEQ ID NO: 13868 - protein, 10 aa, Artificial Sequence
  Synthetic Peptide encoding a CDR
QSYDSSSIST

SEQ ID NO: 13869 - protein, 11 aa, Artificial Sequence
  Synthetic Peptide encoding a CDR
ATVEAGLSGSV

SEQ ID NO: 13870 - protein, 9 aa, Artificial Sequence
  Synthetic Peptide encoding a CDR
QQWRSNPFT

SEQ ID NO: 13871 - protein, 9 aa, Artificial Sequence
  Synthetic Peptide encoding a CDR
QQDYTSPWT

SEQ ID NO: 13872 - protein, 9 aa, Artificial Sequence
  Synthetic Peptide encoding a CDR
QQAEYMPLT

SEQ ID NO: 13873 - protein, 9 aa, Artificial Sequence
  Synthetic Peptide encoding a CDR
QQNNNWPTT

SEQ ID NO: 13874 - protein, 9 aa, Artificial Sequence
  Synthetic Peptide encoding a CDR
FQYSHVPWT

SEQ ID NO: 13875 - protein, 9 aa, Artificial Sequence
  Synthetic Peptide encoding a CDR
LQHHSYPLT

SEQ ID NO: 13876 - protein, 9 aa, Artificial Sequence
  Synthetic Peptide encoding a CDR
WQGTHFPGT

SEQ ID NO: 13877 - protein, 9 aa, Artificial Sequence
  Synthetic Peptide encoding a CDR
QQSDSLPIT

SEQ ID NO: 13878 - protein, 9 aa, Artificial Sequence
  Synthetic Peptide encoding a CDR
QNDYSYPLT

SEQ ID NO: 13879 - protein, 9 aa, Artificial Sequence
  Synthetic Peptide encoding a CDR
SQSTHVPWT

SEQ ID NO: 13880 - protein, 9 aa, Artificial Sequence
  Synthetic Peptide encoding a CDR
QQSYSTPFT

SEQ ID NO: 13881 - protein, 5 aa, Artificial Sequence
  Synthetic Peptide encoding a CDR
QVLQS

SEQ ID NO: 13882 - protein, 9 aa, Artificial Sequence
  Synthetic Peptide encoding a CDR
QQSREYPYT

SEQ ID NO: 13883 - protein, 9 aa, Artificial Sequence
  Synthetic Peptide encoding a CDR
HQYGSSPRT

SEQ ID NO: 13884 - protein, 10 aa, Artificial Sequence
  Synthetic Peptide encoding a CDR
SQSTHVPPLT

SEQ ID NO: 13885 - protein, 6 aa, Artificial Sequence
  Synthetic Peptide encoding a CDR
QQDYSS

SEQ ID NO: 13886 - protein, 9 aa, Artificial Sequence
  Synthetic Peptide encoding a CDR
HQYSKLPWT

SEQ ID NO: 13887 - protein, 9 aa, Artificial Sequence
  Synthetic Peptide encoding a CDR
GADDNGGYV

SEQ ID NO: 13888 - protein, 9 aa, Artificial Sequence
  Synthetic Peptide encoding a CDR
GADDNGGYV

SEQ ID NO: 13889 - protein, 9 aa, Artificial Sequence
  Synthetic Peptide encoding a CDR
GTDYTGGYV

SEQ ID NO: 13890 - protein, 9 aa, Artificial Sequence
  Synthetic Peptide encoding a CDR
QQYNSYPPT

SEQ ID NO: 13891 - protein, 9 aa, Artificial Sequence
  Synthetic Peptide encoding a CDR
QQYNSYPPT

SEQ ID NO: 13892 - protein, 9 aa, Artificial Sequence
  Synthetic Peptide encoding a CDR
QSSDGSKVV

SEQ ID NO: 13893 - protein, 9 aa, Artificial Sequence
  Synthetic Peptide encoding a CDR
QEWSGYPYT

SEQ ID NO: 13894 - protein, 9 aa, Artificial Sequence
  Synthetic Peptide encoding a CDR
SQNTPVPPK

SEQ ID NO: 13895 - protein, 8 aa, Artificial Sequence
  Synthetic Peptide encoding a CDR
LQHNTYPA

SEQ ID NO: 13896 - protein, 11 aa, Artificial Sequence
  Synthetic Peptide encoding a CDR
GTWDSSLRGWV

SEQ ID NO: 13897 - protein, 9 aa, Artificial Sequence
  Synthetic Peptide encoding a CDR
ATWDDSLSG

SEQ ID NO: 13898 - protein, 9 aa, Artificial Sequence
  Synthetic Peptide encoding a CDR
QQHYTTPPT

SEQ ID NO: 13899 - protein, 9 aa, Artificial Sequence
  Synthetic Peptide encoding a CDR
QVWENHGWV

SEQ ID NO: 13900 - protein, 4 aa, Artificial Sequence
  Synthetic Peptide encoding a CDR
QVYE

SEQ ID NO: 13901 - protein, 10 aa, Artificial Sequence
  Synthetic Peptide encoding a CDR
GSLVGNWDVI

SEQ ID NO: 13902 - protein, 10 aa, Artificial Sequence
  Synthetic Peptide encoding a CDR
QQYEFFGQGT

SEQ ID NO: 13903 - protein, 9 aa, Artificial Sequence
  Synthetic Peptide encoding a CDR
QQYGTSPYT

SEQ ID NO: 13904 - protein, 9 aa, Artificial Sequence
  Synthetic Peptide encoding a CDR
QQYNSYPLT

SEQ ID NO: 13905 - protein, 11 aa, Artificial Sequence
  Synthetic Peptide encoding a CDR
QQRSNWPPMYT

SEQ ID NO: 13906 - protein, 9 aa, Artificial Sequence
  Synthetic Peptide encoding a CDR
MQALQTPRT

SEQ ID NO: 13907 - protein, 9 aa, Artificial Sequence
  Synthetic Peptide encoding a CDR
QQYTFGPGT

SEQ ID NO: 13908 - protein, 9 aa, Artificial Sequence
  Synthetic Peptide encoding a CDR
HQYHRSPLT

SEQ ID NO: 13909 - protein, 9 aa, Artificial Sequence
  Synthetic Peptide encoding a CDR
QHHYSAPWT

SEQ ID NO: 13910 - protein, 9 aa, Artificial Sequence
  Synthetic Peptide encoding a CDR
GQGNRLPYT

SEQ ID NO: 13911 - protein, 5 aa, Artificial Sequence
  Synthetic Peptide encoding a CDR
QQSRT

SEQ ID NO: 13912 - protein, 9 aa, Artificial Sequence
  Synthetic Peptide encoding a CDR
QQYWSLPRT

SEQ ID NO: 13913 - protein, 9 aa, Artificial Sequence
  Synthetic Peptide encoding a CDR
QQHYTTLPT

SEQ ID NO: 13914 - protein, 9 aa, Artificial Sequence
  Synthetic Peptide encoding a CDR
QQGNTLPWT

SEQ ID NO: 13915 - protein, 8 aa, Artificial Sequence
  Synthetic Peptide encoding a CDR
LQYDNLWT

SEQ ID NO: 13916 - protein, 9 aa, Artificial Sequence
  Synthetic Peptide encoding a CDR
QHFWSNPYT

SEQ ID NO: 13917 - protein, 9 aa, Artificial Sequence
  Synthetic Peptide encoding a CDR
FQGSHVPPT

SEQ ID NO: 13918 - protein, 8 aa, Artificial Sequence
  Synthetic Peptide encoding a CDR
QHHYGTFT

SEQ ID NO: 13919 - protein, 9 aa, Artificial Sequence
  Synthetic Peptide encoding a CDR
QQYNTYPFT

SEQ ID NO: 13920 - protein, 11 aa, Artificial Sequence
  Synthetic Peptide encoding a CDR
QSYDNSLSSWV

SEQ ID NO: 13921 - protein, 11 aa, Artificial Sequence
  Synthetic Peptide encoding a CDR
ATWDRTVNVVR

SEQ ID NO: 13922 - protein, 9 aa, Artificial Sequence
  Synthetic Peptide encoding a CDR
QQSYSTPLT

SEQ ID NO: 13923 - protein, 9 aa, Artificial Sequence
  Synthetic Peptide encoding a CDR
QQYWTTPWT

SEQ ID NO: 13924 - protein, 9 aa, Artificial Sequence
  Synthetic Peptide encoding a CDR
QQYWSSPWT

SEQ ID NO: 13925 - protein, 9 aa, Artificial Sequence
  Synthetic Peptide encoding a CDR
QQYWSSPWT

SEQ ID NO: 13926 - protein, 9 aa, Artificial Sequence
  Synthetic Peptide encoding a CDR
QQYHSYPTT

SEQ ID NO: 13927 - protein, 9 aa, Artificial Sequence
  Synthetic Peptide encoding a CDR
MQHLEYPYT

SEQ ID NO: 13928 - protein, 9 aa, Artificial Sequence
  Synthetic Peptide encoding a CDR
MQHIEYPFT

SEQ ID NO: 13929 - protein, 10 aa, Artificial Sequence
  Synthetic Peptide encoding a CDR
SSYTTRSTRV

SEQ ID NO: 13930 - protein, 9 aa, Artificial Sequence
  Synthetic Peptide encoding a CDR
QQSRKVPWT

SEQ ID NO: 13931 - protein, 9 aa, Artificial Sequence
  Synthetic Peptide encoding a CDR
QQYGSSPRT

SEQ ID NO: 13932 - protein, 9 aa, Artificial Sequence
  Synthetic Peptide encoding a CDR
HQYGSSPQT

SEQ ID NO: 13933 - protein, 8 aa, Artificial Sequence
  Synthetic Peptide encoding a CDR
QQSYNLLT

SEQ ID NO: 13934 - protein, 9 aa, Artificial Sequence
  Synthetic Peptide encoding a CDR
QQYGSSPWT

SEQ ID NO: 13935 - protein, 9 aa, Artificial Sequence
  Synthetic Peptide encoding a CDR
WQGTHFPQT

SEQ ID NO: 13936 - protein, 9 aa, Artificial Sequence
  Synthetic Peptide encoding a CDR
WSFAGGYYV

SEQ ID NO: 13937 - protein, 9 aa, Artificial Sequence
  Synthetic Peptide encoding a CDR
QQSTFGQGT

SEQ ID NO: 13938 - protein, 9 aa, Artificial Sequence
  Synthetic Peptide encoding a CDR
QQSSNWPRT

SEQ ID NO: 13939 - protein, 9 aa, Artificial Sequence
  Synthetic Peptide encoding a CDR
QQYNSYPYT

SEQ ID NO: 13940 - protein, 9 aa, Artificial Sequence
  Synthetic Peptide encoding a CDR
QQYLYHPAT

SEQ ID NO: 13941 - protein, 12 aa, Artificial Sequence
  Synthetic Peptide encoding a CDR
IGGKSSSTDGNA

SEQ ID NO: 13942 - protein, 9 aa, Artificial Sequence
  Synthetic Peptide encoding a CDR
QHIRELTRS

SEQ ID NO: 13943 - protein, 9 aa, Artificial Sequence
  Synthetic Peptide encoding a CDR
QQAYSFPRT

SEQ ID NO: 13944 - protein, 9 aa, Artificial Sequence
  Synthetic Peptide encoding a CDR
MQPLQTPIT

SEQ ID NO: 13945 - protein, 9 aa, Artificial Sequence
  Synthetic Peptide encoding a CDR
QNYNSAPFT

SEQ ID NO: 13946 - protein, 9 aa, Artificial Sequence
  Synthetic Peptide encoding a CDR
QQYNSYPLT

SEQ ID NO: 13947 - protein, 9 aa, Artificial Sequence
  Synthetic Peptide encoding a CDR
LQYDEFPLT

SEQ ID NO: 13948 - protein, 9 aa, Artificial Sequence
  Synthetic Peptide encoding a CDR
QHYNSFPYT

SEQ ID NO: 13949 - protein, 9 aa, Artificial Sequence
  Synthetic Peptide encoding a CDR
LQYDEFPYT

SEQ ID NO: 13950 - protein, 11 aa, Artificial Sequence
  Synthetic Peptide encoding a CDR
NLLLSAHGAYT

SEQ ID NO: 13951 - protein, 10 aa, Artificial Sequence
  Synthetic Peptide encoding a CDR
AADSLGGHYV

SEQ ID NO: 13952 - protein, 10 aa, Artificial Sequence
  Synthetic Peptide encoding a CDR
QQYNNWPPYT

SEQ ID NO: 13953 - protein, 9 aa, Artificial Sequence
  Synthetic Peptide encoding a CDR
FQGSGYPLT

SEQ ID NO: 13954 - protein, 9 aa, Artificial Sequence
  Synthetic Peptide encoding a CDR
QQYDNLPLT

SEQ ID NO: 13955 - protein, 9 aa, Artificial Sequence
  Synthetic Peptide encoding a CDR
SQSTHVPYT

SEQ ID NO: 13956 - protein, 10 aa, Artificial Sequence
  Synthetic Peptide encoding a CDR
QAWDTNLGGV

SEQ ID NO: 13957 - protein, 10 aa, Artificial Sequence
  Synthetic Peptide encoding a CDR
HSYDSNNHSV

SEQ ID NO: 13958 - protein, 9 aa, Artificial Sequence
  Synthetic Peptide encoding a CDR
QQGQSYPWT

SEQ ID NO: 13959 - protein, 9 aa, Artificial Sequence
  Synthetic Peptide encoding a CDR
QQYGSSPYT

SEQ ID NO: 13960 - protein, 9 aa, Artificial Sequence
  Synthetic Peptide encoding a CDR
QQANSFPIT

SEQ ID NO: 13961 - protein, 9 aa, Artificial Sequence
  Synthetic Peptide encoding a CDR
QQRSNWPPT

SEQ ID NO: 13962 - protein, 9 aa, Artificial Sequence
  Synthetic Peptide encoding a CDR
MQRVEFPIT

SEQ ID NO: 13963 - protein, 9 aa, Artificial Sequence
  Synthetic Peptide encoding a CDR
LQFFEFPFT

SEQ ID NO: 13964 - protein, 9 aa, Artificial Sequence
  Synthetic Peptide encoding a CDR
QHTNSWPTT

SEQ ID NO: 13965 - protein, 9 aa, Artificial Sequence
  Synthetic Peptide encoding a CDR
QNDYSYPLT

SEQ ID NO: 13966 - protein, 9 aa, Artificial Sequence
  Synthetic Peptide encoding a CDR
QQHYITPLT

SEQ ID NO: 13967 - protein, 9 aa, Artificial Sequence
  Synthetic Peptide encoding a CDR
QHSRELPYT

SEQ ID NO: 13968 - protein, 10 aa, Artificial Sequence
  Synthetic Peptide encoding a CDR
QQSYSSPSTT

SEQ ID NO: 13969 - protein, 10 aa, Artificial Sequence
  Synthetic Peptide encoding a CDR
QAWDSSTAVV

SEQ ID NO: 13970 - protein, 9 aa, Artificial Sequence
  Synthetic Peptide encoding a CDR
RQYSSYPYT

SEQ ID NO: 13971 - protein, 9 aa, Artificial Sequence
  Synthetic Peptide encoding a CDR
QQSPGFPPT

SEQ ID NO: 13972 - protein, 9 aa, Artificial Sequence
  Synthetic Peptide encoding a CDR
MQALQTPLT

SEQ ID NO: 13973 - protein, 9 aa, Artificial Sequence
  Synthetic Peptide encoding a CDR
MQALQTPPT

SEQ ID NO: 13974 - protein, 9 aa, Artificial Sequence
  Synthetic Peptide encoding a CDR
MQTLQTPLT

SEQ ID NO: 13975 - protein, 8 aa, Artificial Sequence
  Synthetic Peptide encoding a CDR
QQYGRSLS

SEQ ID NO: 13976 - protein, 11 aa, Artificial Sequence
  Synthetic Peptide encoding a CDR
AAWDDSLNGWV

SEQ ID NO: 13977 - protein, 8 aa, Artificial Sequence
  Synthetic Peptide encoding a CDR
QQYNSYAT

SEQ ID NO: 13978 - protein, 11 aa, Artificial Sequence
  Synthetic Peptide encoding a CDR
AAWDDSLNGVV

SEQ ID NO: 13979 - protein, 11 aa, Artificial Sequence
  Synthetic Peptide encoding a CDR
QVWDSSSDHVV

SEQ ID NO: 13980 - protein, 9 aa, Artificial Sequence
  Synthetic Peptide encoding a CDR
VLWHSNHWV

SEQ ID NO: 13981 - protein, 9 aa, Artificial Sequence
  Synthetic Peptide encoding a CDR
QQSNEDPPT

SEQ ID NO: 13982 - protein, 8 aa, Artificial Sequence
  Synthetic Peptide encoding a CDR
QQYSNSWT

SEQ ID NO: 13983 - protein, 11 aa, Artificial Sequence
  Synthetic Peptide encoding a CDR
DSRVSTGNHVV

SEQ ID NO: 13984 - protein, 9 aa, Artificial Sequence
  Synthetic Peptide encoding a CDR
QQSNSWPYT

SEQ ID NO: 13985 - protein, 9 aa, Artificial Sequence
  Synthetic Peptide encoding a CDR
HQWSSYPYT

SEQ ID NO: 13986 - protein, 9 aa, Artificial Sequence
  Synthetic Peptide encoding a CDR
HQRRSYPFT

SEQ ID NO: 13987 - protein, 9 aa, Artificial Sequence
  Synthetic Peptide encoding a CDR
LQYGNLLYA

SEQ ID NO: 13988 - protein, 9 aa, Artificial Sequence
  Synthetic Peptide encoding a CDR
QQSHEDPYT

SEQ ID NO: 13989 - protein, 9 aa, Artificial Sequence
  Synthetic Peptide encoding a CDR
LQVYSTPRT

SEQ ID NO: 13990 - protein, 9 aa, Artificial Sequence
  Synthetic Peptide encoding a CDR
QQYKTWPRT

SEQ ID NO: 13991 - protein, 9 aa, Artificial Sequence
  Synthetic Peptide encoding a CDR
HQYSNWMCS

SEQ ID NO: 13992 - protein, 8 aa, Artificial Sequence
  Synthetic Peptide encoding a CDR
QQHHEYPL

SEQ ID NO: 13993 - protein, 10 aa, Artificial Sequence
  Synthetic Peptide encoding a CDR
SSYTTGSRAV

SEQ ID NO: 13994 - protein, 11 aa, Artificial Sequence
  Synthetic Peptide encoding a CDR
GTWDGSLYTML

SEQ ID NO: 13995 - protein, 12 aa, Artificial Sequence
  Synthetic Peptide encoding a CDR
QSYDSSLSGSGV

SEQ ID NO: 13996 - protein, 13 aa, Artificial Sequence
  Synthetic Peptide encoding a CDR
CATWDDNLNVHYV

SEQ ID NO: 13997 - protein, 9 aa, Artificial Sequence
  Synthetic Peptide encoding a CDR
LQSRIFPRT

SEQ ID NO: 13998 - protein, 9 aa, Artificial Sequence
  Synthetic Peptide encoding a CDR
LQSRTIPRT

SEQ ID NO: 13999 - protein, 9 aa, Artificial Sequence
  Synthetic Peptide encoding a CDR
QNDYSYPYT

SEQ ID NO: 14000 - protein, 9 aa, Artificial Sequence
  Synthetic Peptide encoding a CDR
QNDYSYPYT

SEQ ID NO: 14001 - protein, 9 aa, Artificial Sequence
  Synthetic Peptide encoding a CDR
QQDYGFPWT

SEQ ID NO: 14002 - protein, 10 aa, Artificial Sequence
  Synthetic Peptide encoding a CDR
QSYSSGINII

SEQ ID NO: 14003 - protein, 9 aa, Artificial Sequence
  Synthetic Peptide encoding a CDR
HQYNIYPYT

SEQ ID NO: 14004 - protein, 9 aa, Artificial Sequence
  Synthetic Peptide encoding a CDR
QQRSNWPLT

SEQ ID NO: 14005 - protein, 9 aa, Artificial Sequence
  Synthetic Peptide encoding a CDR
QQHNKYPYT

SEQ ID NO: 14006 - protein, 9 aa, Artificial Sequence
  Synthetic Peptide encoding a CDR
HQYNNYPYT

SEQ ID NO: 14007 - protein, 9 aa, Artificial Sequence
  Synthetic Peptide encoding a CDR
QQWNYPSWT

SEQ ID NO: 14008 - protein, 9 aa, Artificial Sequence
  Synthetic Peptide encoding a CDR
QQYYDTPLT

SEQ ID NO: 14009 - protein, 10 aa, Artificial Sequence
  Synthetic Peptide encoding a CDR
LQTTHFPPWT

SEQ ID NO: 14010 - protein, 9 aa, Artificial Sequence
  Synthetic Peptide encoding a CDR
QQSKEVPFT

SEQ ID NO: 14011 - protein, 9 aa, Artificial Sequence
  Synthetic Peptide encoding a CDR
QQFNSYPYT

SEQ ID NO: 14012 - protein, 9 aa, Artificial Sequence
  Synthetic Peptide encoding a CDR
MQHLEYPIT

SEQ ID NO: 14013 - protein, 9 aa, Artificial Sequence
  Synthetic Peptide encoding a CDR
QQSTEDPWT

SEQ ID NO: 14014 - protein, 9 aa, Artificial Sequence
  Synthetic Peptide encoding a CDR
QQSNEVPRT

SEQ ID NO: 14015 - protein, 8 aa, Artificial Sequence
  Synthetic Peptide encoding a CDR
QYNRYPYT

SEQ ID NO: 14016 - protein, 7 aa, Artificial Sequence
  Synthetic Peptide encoding a CDR
HQRGSYT

SEQ ID NO: 14017 - protein, 9 aa, Artificial Sequence
  Synthetic Peptide encoding a CDR
QQSWNTPWT

SEQ ID NO: 14018 - protein, 9 aa, Artificial Sequence
  Synthetic Peptide encoding a CDR
QQSTEDPWT

SEQ ID NO: 14019 - protein, 9 aa, Artificial Sequence
  Synthetic Peptide encoding a CDR
QQWSFNPPT

SEQ ID NO: 14020 - protein, 9 aa, Artificial Sequence
  Synthetic Peptide encoding a CDR
QQRSDWPLT

SEQ ID NO: 14021 - protein, 9 aa, Artificial Sequence
  Synthetic Peptide encoding a CDR
QQRSNWPLT

SEQ ID NO: 14022 - protein, 9 aa, Artificial Sequence
  Synthetic Peptide encoding a CDR
QQWSFNPPT

SEQ ID NO: 14023 - protein, 9 aa, Artificial Sequence
  Synthetic Peptide encoding a CDR
QQWTSNPPT

SEQ ID NO: 14024 - protein, 9 aa, Artificial Sequence
  Synthetic Peptide encoding a CDR
QQDYSSPLT

SEQ ID NO: 14025 - protein, 9 aa, Artificial Sequence
  Synthetic Peptide encoding a CDR
QQWTFNPPT

SEQ ID NO: 14026 - protein, 9 aa, Artificial Sequence
  Synthetic Peptide encoding a CDR
HQWSSNPLT

SEQ ID NO: 14027 - protein, 9 aa, Artificial Sequence
  Synthetic Peptide encoding a CDR
QQRSNWPIT

SEQ ID NO: 14028 - protein, 9 aa, Artificial Sequence
  Synthetic Peptide encoding a CDR
QQWLSNPPT

SEQ ID NO: 14029 - protein, 8 aa, Artificial Sequence
  Synthetic Peptide encoding a CDR
QQFNSSIT

SEQ ID NO: 14030 - protein, 8 aa, Artificial Sequence
  Synthetic Peptide encoding a CDR
LQYDNLLT

SEQ ID NO: 14031 - protein, 9 aa, Artificial Sequence
  Synthetic Peptide encoding a CDR
LQYDEFPLT

SEQ ID NO: 14032 - protein, 9 aa, Artificial Sequence
  Synthetic Peptide encoding a CDR
MQALQTPWT

SEQ ID NO: 14033 - protein, 9 aa, Artificial Sequence
  Synthetic Peptide encoding a CDR
QQNNEDPWT

SEQ ID NO: 14034 - protein, 9 aa, Artificial Sequence
  Synthetic Peptide encoding a CDR
LQHNSYPWT

SEQ ID NO: 14035 - protein, 9 aa, Artificial Sequence
  Synthetic Peptide encoding a CDR
WQGTHFPRT

SEQ ID NO: 14036 - protein, 9 aa, Artificial Sequence
  Synthetic Peptide encoding a CDR
QQLYSTPYT

SEQ ID NO: 14037 - protein, 9 aa, Artificial Sequence
  Synthetic Peptide encoding a CDR
QHSWEIPLT

SEQ ID NO: 14038 - protein, 9 aa, Artificial Sequence
  Synthetic Peptide encoding a CDR
QQYSGYPLT

SEQ ID NO: 14039 - protein, 9 aa, Artificial Sequence
  Synthetic Peptide encoding a CDR
QQYSGYPLT

SEQ ID NO: 14040 - protein, 10 aa, Artificial Sequence
  Synthetic Peptide encoding a CDR
QQHYSTPPYT

SEQ ID NO: 14041 - protein, 10 aa, Artificial Sequence
  Synthetic Peptide encoding a CDR
SQSTHVPPYT

SEQ ID NO: 14042 - protein, 10 aa, Artificial Sequence
  Synthetic Peptide encoding a CDR
SQSTHVPPFT

SEQ ID NO: 14043 - protein, 10 aa, Artificial Sequence
  Synthetic Peptide encoding a CDR
SQSTHVPPFT

SEQ ID NO: 14044 - protein, 9 aa, Artificial Sequence
  Synthetic Peptide encoding a CDR
QQYWSTPWT

SEQ ID NO: 14045 - protein, 10 aa, Artificial Sequence
  Synthetic Peptide encoding a CDR
QQHYSTPPYT

SEQ ID NO: 14046 - protein, 9 aa, Artificial Sequence
  Synthetic Peptide encoding a CDR
SQSTHVPWT

SEQ ID NO: 14047 - protein, 10 aa, Artificial Sequence
  Synthetic Peptide encoding a CDR
AAWDDSLSEF

SEQ ID NO: 14048 - protein, 12 aa, Artificial Sequence
  Synthetic Peptide encoding a CDR
QSYDSSLSGSYV

SEQ ID NO: 14049 - protein, 10 aa, Artificial Sequence
  Synthetic Peptide encoding a CDR
SSYTSSSTLV

SEQ ID NO: 14050 - protein, 8 aa, Artificial Sequence
  Synthetic Peptide encoding a CDR
QQYDNLPL

SEQ ID NO: 14051 - protein, 11 aa, Artificial Sequence
  Synthetic Peptide encoding a CDR
ATWDDNVKSYV

SEQ ID NO: 14052 - protein, 13 aa, Artificial Sequence
  Synthetic Peptide encoding a CDR
QVWDTTGDHPGYV

SEQ ID NO: 14053 - protein, 9 aa, Artificial Sequence
  Synthetic Peptide encoding a CDR
QQYNSYPYT

SEQ ID NO: 14054 - protein, 9 aa, Artificial Sequence
  Synthetic Peptide encoding a CDR
QNDYSYPLT

SEQ ID NO: 14055 - protein, 9 aa, Artificial Sequence
  Synthetic Peptide encoding a CDR
FQGSHVPWT

SEQ ID NO: 14056 - protein, 10 aa, Artificial Sequence
  Synthetic Peptide encoding a CDR
QQRSNWPPFT

SEQ ID NO: 14057 - protein, 9 aa, Artificial Sequence
  Synthetic Peptide encoding a CDR
QQYNSYPYT

SEQ ID NO: 14058 - protein, 11 aa, Artificial Sequence
  Synthetic Peptide encoding a CDR
QSYDSSLSGSV

SEQ ID NO: 14059 - protein, 11 aa, Artificial Sequence
  Synthetic Peptide encoding a CDR
QSYDSSLSGSV

SEQ ID NO: 14060 - protein, 10 aa, Artificial Sequence
  Synthetic Peptide encoding a CDR
QSYDDINHWV

SEQ ID NO: 14061 - protein, 9 aa, Artificial Sequence
  Synthetic Peptide encoding a CDR
QQRSSYPPT

SEQ ID NO: 14062 - protein, 9 aa, Artificial Sequence
  Synthetic Peptide encoding a CDR
QNDYSYPFT

SEQ ID NO: 14063 - protein, 9 aa, Artificial Sequence
  Synthetic Peptide encoding a CDR
QQSNMFPYT

SEQ ID NO: 14064 - protein, 9 aa, Artificial Sequence
  Synthetic Peptide encoding a CDR
HQHYSTPLT

SEQ ID NO: 14065 - protein, 10 aa, Artificial Sequence
  Synthetic Peptide encoding a CDR
GTWDSSLSAW

SEQ ID NO: 14066 - protein, 9 aa, Artificial Sequence
  Synthetic Peptide encoding a CDR
FQGSHVPYT

SEQ ID NO: 14067 - protein, 9 aa, Artificial Sequence
  Synthetic Peptide encoding a CDR
QQNNEDPWT

SEQ ID NO: 14068 - protein, 9 aa, Artificial Sequence
  Synthetic Peptide encoding a CDR
LQSRTIPRT

SEQ ID NO: 14069 - protein, 9 aa, Artificial Sequence
  Synthetic Peptide encoding a CDR
LQSRTIPRT

SEQ ID NO: 14070 - protein, 9 aa, Artificial Sequence
  Synthetic Peptide encoding a CDR
QQYWSSPWT

SEQ ID NO: 14071 - protein, 9 aa, Artificial Sequence
  Synthetic Peptide encoding a CDR
FQASHAPRT

SEQ ID NO: 14072 - protein, 9 aa, Artificial Sequence
  Synthetic Peptide encoding a CDR
NSRDSSGWV

SEQ ID NO: 14073 - protein, 12 aa, Artificial Sequence
  Synthetic Peptide encoding a CDR
SSYTSSSTLVYV

SEQ ID NO: 14074 - protein, 9 aa, Artificial Sequence
  Synthetic Peptide encoding a CDR
SYAGGSTWV

SEQ ID NO: 14075 - protein, 11 aa, Artificial Sequence
  Synthetic Peptide encoding a CDR
SSYTSGRTLYV

SEQ ID NO: 14076 - protein, 11 aa, Artificial Sequence
  Synthetic Peptide encoding a CDR
SSYTSSSTLYV

SEQ ID NO: 14077 - protein, 9 aa, Artificial Sequence
  Synthetic Peptide encoding a CDR
QQGNTLPYT

SEQ ID NO: 14078 - protein, 9 aa, Artificial Sequence
  Synthetic Peptide encoding a CDR
QQYHSYPTT

SEQ ID NO: 14079 - protein, 9 aa, Artificial Sequence
  Synthetic Peptide encoding a CDR
QQYWTTPWT

SEQ ID NO: 14080 - protein, 10 aa, Artificial Sequence
  Synthetic Peptide encoding a CDR
QQSYNWPYTF

SEQ ID NO: 14081 - protein, 9 aa, Artificial Sequence
  Synthetic Peptide encoding a CDR
QQLNSYPLT

SEQ ID NO: 14082 - protein, 8 aa, Artificial Sequence
  Synthetic Peptide encoding a CDR
QHHSDNPW

SEQ ID NO: 14083 - protein, 8 aa, Artificial Sequence
  Synthetic Peptide encoding a CDR
QHHSDNPW

SEQ ID NO: 14084 - protein, 8 aa, Artificial Sequence
  Synthetic Peptide encoding a CDR
QQYGYSPP

SEQ ID NO: 14085 - protein, 8 aa, Artificial Sequence
  Synthetic Peptide encoding a CDR
QQYGDLPF

SEQ ID NO: 14086 - protein, 8 aa, Artificial Sequence
  Synthetic Peptide encoding a CDR
QQYGDLPF

SEQ ID NO: 14087 - protein, 8 aa, Artificial Sequence
  Synthetic Peptide encoding a CDR
QQYGYSPF

SEQ ID NO: 14088 - protein, 8 aa, Artificial Sequence
  Synthetic Peptide encoding a CDR
LQRTNWPL

SEQ ID NO: 14089 - protein, 8 aa, Artificial Sequence
  Synthetic Peptide encoding a CDR
QQRSNWPL

SEQ ID NO: 14090 - protein, 8 aa, Artificial Sequence
  Synthetic Peptide encoding a CDR
QQFNSYPF

SEQ ID NO: 14091 - protein, 8 aa, Artificial Sequence
  Synthetic Peptide encoding a CDR
QQYGDLPF

SEQ ID NO: 14092 - protein, 8 aa, Artificial Sequence
  Synthetic Peptide encoding a CDR
QQYGDLPF

SEQ ID NO: 14093 - protein, 9 aa, Artificial Sequence
  Synthetic Peptide encoding a CDR
WAFENIGGG

SEQ ID NO: 14094 - protein, 9 aa, Artificial Sequence
  Synthetic Peptide encoding a CDR
WAYEAFGGG

SEQ ID NO: 14095 - protein, 9 aa, Artificial Sequence
  Synthetic Peptide encoding a CDR
WAFEAFGGG

SEQ ID NO: 14096 - protein, 9 aa, Artificial Sequence
  Synthetic Peptide encoding a CDR
QHFETFGQG

SEQ ID NO: 14097 - protein, 9 aa, Artificial Sequence
  Synthetic Peptide encoding a CDR
QHFETFGQG

SEQ ID NO: 14098 - protein, 9 aa, Artificial Sequence
  Synthetic Peptide encoding a CDR
NTYEFFGGG

SEQ ID NO: 14099 - protein, 9 aa, Artificial Sequence
  Synthetic Peptide encoding a CDR
QKFEFFGQG

SEQ ID NO: 14100 - protein, 9 aa, Artificial Sequence
  Synthetic Peptide encoding a CDR
QKFEFFGQG

SEQ ID NO: 14101 - protein, 8 aa, Artificial Sequence
  Synthetic Peptide encoding a CDR
QQYAYSPA

SEQ ID NO: 14102 - protein, 8 aa, Artificial Sequence
  Synthetic Peptide encoding a CDR
QQYAYSPA

SEQ ID NO: 14103 - protein, 7 aa, Artificial Sequence
  Synthetic Peptide encoding a CDR
QQYGSSL

SEQ ID NO: 14104 - protein, 7 aa, Artificial Sequence
  Synthetic Peptide encoding a CDR
QQYGRSL

SEQ ID NO: 14105 - protein, 8 aa, Artificial Sequence
  Synthetic Peptide encoding a CDR
QQYGRSLI

SEQ ID NO: 14106 - protein, 8 aa, Artificial Sequence
  Synthetic Peptide encoding a CDR
QQYGRSLI

SEQ ID NO: 14107 - protein, 8 aa, Artificial Sequence
  Synthetic Peptide encoding a CDR
QQYGRSLI

SEQ ID NO: 14108 - protein, 8 aa, Artificial Sequence
  Synthetic Peptide encoding a CDR
QQYGRLLI

SEQ ID NO: 14109 - protein, 9 aa, Artificial Sequence
  Synthetic Peptide encoding a CDR
QQYGSSPQV

SEQ ID NO: 14110 - protein, 8 aa, Artificial Sequence
  Synthetic Peptide encoding a CDR
QSYDTTDV

SEQ ID NO: 14111 - protein, 8 aa, Artificial Sequence
  Synthetic Peptide encoding a CDR
QSYDTTDV

SEQ ID NO: 14112 - protein, 8 aa, Artificial Sequence
  Synthetic Peptide encoding a CDR
QHHYGTFT

SEQ ID NO: 14113 - protein, 9 aa, Artificial Sequence
  Synthetic Peptide encoding a CDR
QQYNTYPFT

SEQ ID NO: 14114 - protein, 9 aa, Artificial Sequence
  Synthetic Peptide encoding a CDR
LQSRTIPRT

SEQ ID NO: 14115 - protein, 9 aa, Artificial Sequence
  Synthetic Peptide encoding a CDR
LQSRTIPRT

SEQ ID NO: 14116 - protein, 9 aa, Artificial Sequence
  Synthetic Peptide encoding a CDR
LQSRTIPRT

SEQ ID NO: 14117 - protein, 9 aa, Artificial Sequence
  Synthetic Peptide encoding a CDR
LQSRIFPRT

SEQ ID NO: 14118 - protein, 9 aa, Artificial Sequence
  Synthetic Peptide encoding a CDR
LQSRIFPRT

SEQ ID NO: 14119 - protein, 9 aa, Artificial Sequence
  Synthetic Peptide encoding a CDR
LQSRIFPRT

SEQ ID NO: 14120 - protein, 9 aa, Artificial Sequence
  Synthetic Peptide encoding a CDR
LQSRIFPRT

SEQ ID NO: 14121 - protein, 9 aa, Artificial Sequence
  Synthetic Peptide encoding a CDR
QQSNMFPYT

SEQ ID NO: 14122 - protein, 7 aa, Artificial Sequence
  Synthetic Peptide encoding a CDR
GYAFSSY

SEQ ID NO: 14123 - protein, 6 aa, Artificial Sequence
  Synthetic Peptide encoding a CDR
GYTFTD

SEQ ID NO: 14124 - protein, 8 aa, Artificial Sequence
  Synthetic Peptide encoding a CDR
GFTFSSFG

SEQ ID NO: 14125 - protein, 8 aa, Artificial Sequence
  Synthetic Peptide encoding a CDR
GYTFTDYY

SEQ ID NO: 14126 - protein, 8 aa, Artificial Sequence
  Synthetic Peptide encoding a CDR
GYDFTTYW

SEQ ID NO: 14127 - protein, 8 aa, Artificial Sequence
  Synthetic Peptide encoding a CDR
GYTFRHYS

SEQ ID NO: 14128 - protein, 8 aa, Artificial Sequence
  Synthetic Peptide encoding a CDR
GGTFSNYW

SEQ ID NO: 14129 - protein, 8 aa, Artificial Sequence
  Synthetic Peptide encoding a CDR
GYTFASQW

SEQ ID NO: 14130 - protein, 8 aa, Artificial Sequence
  Synthetic Peptide encoding a CDR
GYSFTDYY

SEQ ID NO: 14131 - protein, 8 aa, Artificial Sequence
  Synthetic Peptide encoding a CDR
GYTFSNYW

SEQ ID NO: 14132 - protein, 8 aa, Artificial Sequence
  Synthetic Peptide encoding a CDR
GYTFTDYY

SEQ ID NO: 14133 - protein, 8 aa, Artificial Sequence
  Synthetic Peptide encoding a CDR
GYTFTSYV

SEQ ID NO: 14134 - protein, 10 aa, Artificial Sequence
  Synthetic Peptide encoding a CDR
GGSISTSGMG

SEQ ID NO: 14135 - protein, 10 aa, Artificial Sequence
  Synthetic Peptide encoding a CDR
GGSISTSGMG

SEQ ID NO: 14136 - protein, 7 aa, Artificial Sequence
  Synthetic Peptide encoding a CDR
GYAFSSY

SEQ ID NO: 14137 - protein, 8 aa, Artificial Sequence
  Synthetic Peptide encoding a CDR
GVSLPDYG

SEQ ID NO: 14138 - protein, 8 aa, Artificial Sequence
  Synthetic Peptide encoding a CDR
GVSLPDYG

SEQ ID NO: 14139 - protein, 8 aa, Artificial Sequence
  Synthetic Peptide encoding a CDR
GVSLPDYG

SEQ ID NO: 14140 - protein, 8 aa, Artificial Sequence
  Synthetic Peptide encoding a CDR
GFTFNDYA

SEQ ID NO: 14141 - protein, 8 aa, Artificial Sequence
  Synthetic Peptide encoding a CDR
GYAFSYSW

SEQ ID NO: 14142 - protein, 8 aa, Artificial Sequence
  Synthetic Peptide encoding a CDR
GYEFSRSW

SEQ ID NO: 14143 - protein, 8 aa, Artificial Sequence
  Synthetic Peptide encoding a CDR
GFTFSDYG

SEQ ID NO: 14144 - protein, 10 aa, Artificial Sequence
  Synthetic Peptide encoding a CDR
GDSVSSNSAA

SEQ ID NO: 14145 - protein, 8 aa, Artificial Sequence
  Synthetic Peptide encoding a CDR
GGTFSSYA

SEQ ID NO: 14146 - protein, 8 aa, Artificial Sequence
  Synthetic Peptide encoding a CDR
GGSFSAYY

SEQ ID NO: 14147 - protein, 8 aa, Artificial Sequence
  Synthetic Peptide encoding a CDR
GYTFTDYY

SEQ ID NO: 14148 - protein, 8 aa, Artificial Sequence
  Synthetic Peptide encoding a CDR
GFAFSSST

SEQ ID NO: 14149 - protein, 8 aa, Artificial Sequence
  Synthetic Peptide encoding a CDR
GFTFSSYG

SEQ ID NO: 14150 - protein, 9 aa, Artificial Sequence
  Synthetic Peptide encoding a CDR
GFSITSDYS

SEQ ID NO: 14151 - protein, 8 aa, Artificial Sequence
  Synthetic Peptide encoding a CDR
GYTFTSYY

SEQ ID NO: 14152 - protein, 7 aa, Artificial Sequence
  Synthetic Peptide encoding a CDR
GYTFTNY

SEQ ID NO: 14153 - protein, 8 aa, Artificial Sequence
  Synthetic Peptide encoding a CDR
GYTFTNYG

SEQ ID NO: 14154 - protein, 8 aa, Artificial Sequence
  Synthetic Peptide encoding a CDR
GFTFSSYD

SEQ ID NO: 14155 - protein, 8 aa, Artificial Sequence
  Synthetic Peptide encoding a CDR
GYSFTAYS

SEQ ID NO: 14156 - protein, 8 aa, Artificial Sequence
  Synthetic Peptide encoding a CDR
GYSFTAYS

SEQ ID NO: 14157 - protein, 8 aa, Artificial Sequence
  Synthetic Peptide encoding a CDR
GYTFTNYG

SEQ ID NO: 14158 - protein, 7 aa, Artificial Sequence
  Synthetic Peptide encoding a CDR
GYTFTSY

SEQ ID NO: 14159 - protein, 8 aa, Artificial Sequence
  Synthetic Peptide encoding a CDR
GYTFSSYW

SEQ ID NO: 14160 - protein, 8 aa, Artificial Sequence
  Synthetic Peptide encoding a CDR
GYTLTDHT

SEQ ID NO: 14161 - protein, 8 aa, Artificial Sequence
  Synthetic Peptide encoding a CDR
GDSITSYY

SEQ ID NO: 14162 - protein, 8 aa, Artificial Sequence
  Synthetic Peptide encoding a CDR
GFTFSSYA

SEQ ID NO: 14163 - protein, 8 aa, Artificial Sequence
  Synthetic Peptide encoding a CDR
GFTFSSHG

SEQ ID NO: 14164 - protein, 8 aa, Artificial Sequence
  Synthetic Peptide encoding a CDR
GYTFTEYI

SEQ ID NO: 14165 - protein, 8 aa, Artificial Sequence
  Synthetic Peptide encoding a CDR
GFTFSTSG

SEQ ID NO: 14166 - protein, 8 aa, Artificial Sequence
  Synthetic Peptide encoding a CDR
GYTFTSYF

SEQ ID NO: 14167 - protein, 8 aa, Artificial Sequence
  Synthetic Peptide encoding a CDR
GYTFTSYV

SEQ ID NO: 14168 - protein, 10 aa, Artificial Sequence
  Synthetic Peptide encoding a CDR
GGSISSSNYY

SEQ ID NO: 14169 - protein, 8 aa, Artificial Sequence
  Synthetic Peptide encoding a CDR
GYTFTNTG

SEQ ID NO: 14170 - protein, 9 aa, Artificial Sequence
  Synthetic Peptide encoding a CDR
SGFDFSRYW

SEQ ID NO: 14171 - protein, 8 aa, Artificial Sequence
  Synthetic Peptide encoding a CDR
GYSFTTYW

SEQ ID NO: 14172 - protein, 8 aa, Artificial Sequence
  Synthetic Peptide encoding a CDR
GYTLTELS

SEQ ID NO: 14173 - protein, 8 aa, Artificial Sequence
  Synthetic Peptide encoding a CDR
GYTLTELS

SEQ ID NO: 14174 - protein, 10 aa, Artificial Sequence
  Synthetic Peptide encoding a CDR
GFSLSTSGMG

SEQ ID NO: 14175 - protein, 8 aa, Artificial Sequence
  Synthetic Peptide encoding a CDR
GYTFTNYG

SEQ ID NO: 14176 - protein, 8 aa, Artificial Sequence
  Synthetic Peptide encoding a CDR
GFTFSGYA

SEQ ID NO: 14177 - protein, 8 aa, Artificial Sequence
  Synthetic Peptide encoding a CDR
GFSLTNYG

SEQ ID NO: 14178 - protein, 8 aa, Artificial Sequence
  Synthetic Peptide encoding a CDR
GYTFTNYY

SEQ ID NO: 14179 - protein, 8 aa, Artificial Sequence
  Synthetic Peptide encoding a CDR
GFTFSSYA

SEQ ID NO: 14180 - protein, 8 aa, Artificial Sequence
  Synthetic Peptide encoding a CDR
GFNIEDYY

SEQ ID NO: 14181 - protein, 8 aa, Artificial Sequence
  Synthetic Peptide encoding a CDR
GFTFSSYG

SEQ ID NO: 14182 - protein, 8 aa, Artificial Sequence
  Synthetic Peptide encoding a CDR
GYAFTNYW

SEQ ID NO: 14183 - protein, 8 aa, Artificial Sequence
  Synthetic Peptide encoding a CDR
GFTFSDYW

SEQ ID NO: 14184 - protein, 8 aa, Artificial Sequence
  Synthetic Peptide encoding a CDR
GGTFSSYA

SEQ ID NO: 14185 - protein, 8 aa, Artificial Sequence
  Synthetic Peptide encoding a CDR
GYTFTAHI

SEQ ID NO: 14186 - protein, 8 aa, Artificial Sequence
  Synthetic Peptide encoding a CDR
GYTFTGYF

SEQ ID NO: 14187 - protein, 8 aa, Artificial Sequence
  Synthetic Peptide encoding a CDR
GYTFTTYG

SEQ ID NO: 14188 - protein, 8 aa, Artificial Sequence
  Synthetic Peptide encoding a CDR
GSSFTGYN

SEQ ID NO: 14189 - protein, 8 aa, Artificial Sequence
  Synthetic Peptide encoding a CDR
GFSVTNYG

SEQ ID NO: 14190 - protein, 8 aa, Artificial Sequence
  Synthetic Peptide encoding a CDR
GFAFSHYA

SEQ ID NO: 14191 - protein, 8 aa, Artificial Sequence
  Synthetic Peptide encoding a CDR
GFSLSRHA

SEQ ID NO: 14192 - protein, 6 aa, Artificial Sequence
  Synthetic Peptide encoding a CDR
GFSLSY

SEQ ID NO: 14193 - protein, 8 aa, Artificial Sequence
  Synthetic Peptide encoding a CDR
GFTFSRYK

SEQ ID NO: 14194 - protein, 8 aa, Artificial Sequence
  Synthetic Peptide encoding a CDR
GFTFSRYK

SEQ ID NO: 14195 - protein, 14 aa, Artificial Sequence
  Synthetic Peptide encoding a CDR
GVVQPGRFTFSSYG

SEQ ID NO: 14196 - protein, 8 aa, Artificial Sequence
  Synthetic Peptide encoding a CDR
GFTFSSYG

SEQ ID NO: 14197 - protein, 8 aa, Artificial Sequence
  Synthetic Peptide encoding a CDR
GYTFNDYE

SEQ ID NO: 14198 - protein, 10 aa, Artificial Sequence
  Synthetic Peptide encoding a CDR
GGSISSFNYY

SEQ ID NO: 14199 - protein, 8 aa, Artificial Sequence
  Synthetic Peptide encoding a CDR
GFTFSNYA

SEQ ID NO: 14200 - protein, 8 aa, Artificial Sequence
  Synthetic Peptide encoding a CDR
GFTFSDYY

SEQ ID NO: 14201 - protein, 8 aa, Artificial Sequence
  Synthetic Peptide encoding a CDR
GFNIKDTY

SEQ ID NO: 14202 - protein, 8 aa, Artificial Sequence
  Synthetic Peptide encoding a CDR
GFTFSDYE

SEQ ID NO: 14203 - protein, 8 aa, Artificial Sequence
  Synthetic Peptide encoding a CDR
GYNIRDYF

SEQ ID NO: 14204 - protein, 10 aa, Artificial Sequence
  Synthetic Peptide encoding a CDR
GDSTAACNSF

SEQ ID NO: 14205 - protein, 8 aa, Artificial Sequence
  Synthetic Peptide encoding a CDR
GYEFIDCT

SEQ ID NO: 14206 - protein, 8 aa, Artificial Sequence
  Synthetic Peptide encoding a CDR
GGTFSMYG

SEQ ID NO: 14207 - protein, 8 aa, Artificial Sequence
  Synthetic Peptide encoding a CDR
GFTFSNYW

SEQ ID NO: 14208 - protein, 13 aa, Artificial Sequence
  Synthetic Peptide encoding a CDR
GGKKPGSTFSSYT

SEQ ID NO: 14209 - protein, 8 aa, Artificial Sequence
  Synthetic Peptide encoding a CDR
GFTFSSYG

SEQ ID NO: 14210 - protein, 8 aa, Artificial Sequence
  Synthetic Peptide encoding a CDR
GFTFSWYS

SEQ ID NO: 14211 - protein, 8 aa, Artificial Sequence
  Synthetic Peptide encoding a CDR
GFSLTKYG

SEQ ID NO: 14212 - protein, 8 aa, Artificial Sequence
  Synthetic Peptide encoding a CDR
GFTFSRNG

SEQ ID NO: 14213 - protein, 9 aa, Artificial Sequence
  Synthetic Peptide encoding a CDR
GYSISDDHA

SEQ ID NO: 14214 - protein, 10 aa, Artificial Sequence
  Synthetic Peptide encoding a CDR
GDSVSSYNAV

SEQ ID NO: 14215 - protein, 8 aa, Artificial Sequence
  Synthetic Peptide encoding a CDR
GYSFTTFW

SEQ ID NO: 14216 - protein, 8 aa, Artificial Sequence
  Synthetic Peptide encoding a CDR
GYTFTNTG

SEQ ID NO: 14217 - protein, 8 aa, Artificial Sequence
  Synthetic Peptide encoding a CDR
GYTFTRYW

SEQ ID NO: 14218 - protein, 8 aa, Artificial Sequence
  Synthetic Peptide encoding a CDR
GYIFTNYN

SEQ ID NO: 14219 - protein, 15 aa, Artificial Sequence
  Synthetic Peptide encoding a CDR
ELVRPGTGYAFTNYL

SEQ ID NO: 14220 - protein, 8 aa, Artificial Sequence
  Synthetic Peptide encoding a CDR
GPTFSDYY

SEQ ID NO: 14221 - protein, 8 aa, Artificial Sequence
  Synthetic Peptide encoding a CDR
GFSLTSYG

SEQ ID NO: 14222 - protein, 8 aa, Artificial Sequence
  Synthetic Peptide encoding a CDR
GFTFSNYW

SEQ ID NO: 14223 - protein, 8 aa, Artificial Sequence
  Synthetic Peptide encoding a CDR
GGTFSSYA

SEQ ID NO: 14224 - protein, 10 aa, Artificial Sequence
  Synthetic Peptide encoding a CDR
GGSISSSSYY

SEQ ID NO: 14225 - protein, 10 aa, Artificial Sequence
  Synthetic Peptide encoding a CDR
GGSVSSGSYY

SEQ ID NO: 14226 - protein, 10 aa, Artificial Sequence
  Synthetic Peptide encoding a CDR
GGSVSSGSYY

SEQ ID NO: 14227 - protein, 10 aa, Artificial Sequence
  Synthetic Peptide encoding a CDR
GYSITIDYTW

SEQ ID NO: 14228 - protein, 10 aa, Artificial Sequence
  Synthetic Peptide encoding a CDR
GYSITSDYTW

SEQ ID NO: 14229 - protein, 10 aa, Artificial Sequence
  Synthetic Peptide encoding a CDR
GYSITSDYTW

SEQ ID NO: 14230 - protein, 9 aa, Artificial Sequence
  Synthetic Peptide encoding a CDR
GFSFNTYAM

SEQ ID NO: 14231 - protein, 8 aa, Artificial Sequence
  Synthetic Peptide encoding a CDR
GYAFSSSW

SEQ ID NO: 14232 - protein, 8 aa, Artificial Sequence
  Synthetic Peptide encoding a CDR
GYTFTNSW

SEQ ID NO: 14233 - protein, 8 aa, Artificial Sequence
  Synthetic Peptide encoding a CDR
GDSISSYY

SEQ ID NO: 14234 - protein, 8 aa, Artificial Sequence
  Synthetic Peptide encoding a CDR
GFTFSSYT

SEQ ID NO: 14235 - protein, 8 aa, Artificial Sequence
  Synthetic Peptide encoding a CDR
GGTFSSYA

SEQ ID NO: 14236 - protein, 8 aa, Artificial Sequence
  Synthetic Peptide encoding a CDR
GGTFSSYA

SEQ ID NO: 14237 - protein, 8 aa, Artificial Sequence
  Synthetic Peptide encoding a CDR
GFTFSSYA

SEQ ID NO: 14238 - protein, 8 aa, Artificial Sequence
  Synthetic Peptide encoding a CDR
DDSISSYY

SEQ ID NO: 14239 - protein, 9 aa, Artificial Sequence
  Synthetic Peptide encoding a CDR
GYSITSGYS

SEQ ID NO: 14240 - protein, 8 aa, Artificial Sequence
  Synthetic Peptide encoding a CDR
GFTFSTYQ

SEQ ID NO: 14241 - protein, 8 aa, Artificial Sequence
  Synthetic Peptide encoding a CDR
GFTFSTYE

SEQ ID NO: 14242 - protein, 8 aa, Artificial Sequence
  Synthetic Peptide encoding a CDR
GFTFSNYG

SEQ ID NO: 14243 - protein, 8 aa, Artificial Sequence
  Synthetic Peptide encoding a CDR
GITFSNSG

SEQ ID NO: 14244 - protein, 8 aa, Artificial Sequence
  Synthetic Peptide encoding a CDR
GFTFSDSW

SEQ ID NO: 14245 - protein, 9 aa, Artificial Sequence
  Synthetic Peptide encoding a CDR
GIDLSSNGL

SEQ ID NO: 14246 - protein, 8 aa, Artificial Sequence
  Synthetic Peptide encoding a CDR
GFTFSGYG

SEQ ID NO: 14247 - protein, 10 aa, Artificial Sequence
  Synthetic Peptide encoding a CDR
GGSISSGGYY

SEQ ID NO: 14248 - protein, 8 aa, Artificial Sequence
  Synthetic Peptide encoding a CDR
GGSFSGNY

SEQ ID NO: 14249 - protein, 8 aa, Artificial Sequence
  Synthetic Peptide encoding a CDR
GFAFSRYG

SEQ ID NO: 14250 - protein, 8 aa, Artificial Sequence
  Synthetic Peptide encoding a CDR
GYTFTEYT

SEQ ID NO: 14251 - protein, 10 aa, Artificial Sequence
  Synthetic Peptide encoding a CDR
GFSLSTSNMG

SEQ ID NO: 14252 - protein, 8 aa, Artificial Sequence
  Synthetic Peptide encoding a CDR
GYRFTDYP

SEQ ID NO: 14253 - protein, 8 aa, Artificial Sequence
  Synthetic Peptide encoding a CDR
GFTFSSYA

SEQ ID NO: 14254 - protein, 8 aa, Artificial Sequence
  Synthetic Peptide encoding a CDR
GYTFTSYV

SEQ ID NO: 14255 - protein, 8 aa, Artificial Sequence
  Synthetic Peptide encoding a CDR
GFTFEAYA

SEQ ID NO: 14256 - protein, 8 aa, Artificial Sequence
  Synthetic Peptide encoding a CDR
GFTFSFYG

SEQ ID NO: 14257 - protein, 8 aa, Artificial Sequence
  Synthetic Peptide encoding a CDR
GFSLSSQG

SEQ ID NO: 14258 - protein, 8 aa, Artificial Sequence
  Synthetic Peptide encoding a CDR
GFTFSSYA

SEQ ID NO: 14259 - protein, 8 aa, Artificial Sequence
  Synthetic Peptide encoding a CDR
GYTFTGYV

SEQ ID NO: 14260 - protein, 8 aa, Artificial Sequence
  Synthetic Peptide encoding a CDR
GYTFTGYY

SEQ ID NO: 14261 - protein, 8 aa, Artificial Sequence
  Synthetic Peptide encoding a CDR
GFTFSSYA

SEQ ID NO: 14262 - protein, 8 aa, Artificial Sequence
  Synthetic Peptide encoding a CDR
GYSFTGYF

SEQ ID NO: 14263 - protein, 8 aa, Artificial Sequence
  Synthetic Peptide encoding a CDR
GFTFSSYA

SEQ ID NO: 14264 - protein, 8 aa, Artificial Sequence
  Synthetic Peptide encoding a CDR
GGTFSSYA

SEQ ID NO: 14265 - protein, 10 aa, Artificial Sequence
  Synthetic Peptide encoding a CDR
GGSISNSYFS

SEQ ID NO: 14266 - protein, 8 aa, Artificial Sequence
  Synthetic Peptide encoding a CDR
GFIFSRYG

SEQ ID NO: 14267 - protein, 8 aa, Artificial Sequence
  Synthetic Peptide encoding a CDR
GYVFTNYW

SEQ ID NO: 14268 - protein, 8 aa, Artificial Sequence
  Synthetic Peptide encoding a CDR
GYTFTDHA

SEQ ID NO: 14269 - protein, 8 aa, Artificial Sequence
  Synthetic Peptide encoding a CDR
GYTFTDHA

SEQ ID NO: 14270 - protein, 8 aa, Artificial Sequence
  Synthetic Peptide encoding a CDR
GYTFTNYG

SEQ ID NO: 14271 - protein, 8 aa, Artificial Sequence
  Synthetic Peptide encoding a CDR
GGSISSYG

SEQ ID NO: 14272 - protein, 8 aa, Artificial Sequence
  Synthetic Peptide encoding a CDR
GFTVSSNY

SEQ ID NO: 14273 - protein, 8 aa, Artificial Sequence
  Synthetic Peptide encoding a CDR
GYSLTDNW

SEQ ID NO: 14274 - protein, 8 aa, Artificial Sequence
  Synthetic Peptide encoding a CDR
GYSFSAYT

SEQ ID NO: 14275 - protein, 10 aa, Artificial Sequence
  Synthetic Peptide encoding a CDR
GFSITTSGYY

SEQ ID NO: 14276 - protein, 8 aa, Artificial Sequence
  Synthetic Peptide encoding a CDR
GFTFRSYG

SEQ ID NO: 14277 - protein, 9 aa, Artificial Sequence
  Synthetic Peptide encoding a CDR
GGSISSSNW

SEQ ID NO: 14278 - protein, 8 aa, Artificial Sequence
  Synthetic Peptide encoding a CDR
GFTFSSYG

SEQ ID NO: 14279 - protein, 10 aa, Artificial Sequence
  Synthetic Peptide encoding a CDR
GDSVSGNSAT

SEQ ID NO: 14280 - protein, 8 aa, Artificial Sequence
  Synthetic Peptide encoding a CDR
GYSFTNFW

SEQ ID NO: 14281 - protein, 8 aa, Artificial Sequence
  Synthetic Peptide encoding a CDR
GYNFSNKW

SEQ ID NO: 14282 - protein, 8 aa, Artificial Sequence
  Synthetic Peptide encoding a CDR
GGTFSSYA

SEQ ID NO: 14283 - protein, 8 aa, Artificial Sequence
  Synthetic Peptide encoding a CDR
GFTFDDYG

SEQ ID NO: 14284 - protein, 8 aa, Artificial Sequence
  Synthetic Peptide encoding a CDR
GFTFDDYG

SEQ ID NO: 14285 - protein, 8 aa, Artificial Sequence
  Synthetic Peptide encoding a CDR
GFTFSSFG

SEQ ID NO: 14286 - protein, 8 aa, Artificial Sequence
  Synthetic Peptide encoding a CDR
GYIFTNYG

SEQ ID NO: 14287 - protein, 8 aa, Artificial Sequence
  Synthetic Peptide encoding a CDR
GFTFSSYD

SEQ ID NO: 14288 - protein, 8 aa, Artificial Sequence
  Synthetic Peptide encoding a CDR
GYTFTSYA

SEQ ID NO: 14289 - protein, 8 aa, Artificial Sequence
  Synthetic Peptide encoding a CDR
GYSFTGYY

SEQ ID NO: 14290 - protein, 9 aa, Artificial Sequence
  Synthetic Peptide encoding a CDR
GYSITSGYG

SEQ ID NO: 14291 - protein, 8 aa, Artificial Sequence
  Synthetic Peptide encoding a CDR
GYTFTNFW

SEQ ID NO: 14292 - protein, 8 aa, Artificial Sequence
  Synthetic Peptide encoding a CDR
GYTFTSYW

SEQ ID NO: 14293 - protein, 8 aa, Artificial Sequence
  Synthetic Peptide encoding a CDR
GYSITSGY

SEQ ID NO: 14294 - protein, 10 aa, Artificial Sequence
  Synthetic Peptide encoding a CDR
GFRFTFNNYY

SEQ ID NO: 14295 - protein, 8 aa, Artificial Sequence
  Synthetic Peptide encoding a CDR
GGSFSGYY

SEQ ID NO: 14296 - protein, 8 aa, Artificial Sequence
  Synthetic Peptide encoding a CDR
GFTFSRYA

SEQ ID NO: 14297 - protein, 8 aa, Artificial Sequence
  Synthetic Peptide encoding a CDR
GYTITSGY

SEQ ID NO: 14298 - protein, 8 aa, Artificial Sequence
  Synthetic Peptide encoding a CDR
GYSFPNYW

SEQ ID NO: 14299 - protein, 8 aa, Artificial Sequence
  Synthetic Peptide encoding a CDR
GFTFSNAW

SEQ ID NO: 14300 - protein, 8 aa, Artificial Sequence
  Synthetic Peptide encoding a CDR
GFTFDDYA

SEQ ID NO: 14301 - protein, 8 aa, Artificial Sequence
  Synthetic Peptide encoding a CDR
GGTFSSYA

SEQ ID NO: 14302 - protein, 8 aa, Artificial Sequence
  Synthetic Peptide encoding a CDR
GYTFTDYS

SEQ ID NO: 14303 - protein, 8 aa, Artificial Sequence
  Synthetic Peptide encoding a CDR
GYTFTHYS

SEQ ID NO: 14304 - protein, 8 aa, Artificial Sequence
  Synthetic Peptide encoding a CDR
GYTFTDYY

SEQ ID NO: 14305 - protein, 8 aa, Artificial Sequence
  Synthetic Peptide encoding a CDR
GYTFTDYY

SEQ ID NO: 14306 - protein, 8 aa, Artificial Sequence
  Synthetic Peptide encoding a CDR
GYSFTSYW

SEQ ID NO: 14307 - protein, 8 aa, Artificial Sequence
  Synthetic Peptide encoding a CDR
GFSLTTYD

SEQ ID NO: 14308 - protein, 8 aa, Artificial Sequence
  Synthetic Peptide encoding a CDR
GYTFTDYI

SEQ ID NO: 14309 - protein, 8 aa, Artificial Sequence
  Synthetic Peptide encoding a CDR
GFTFSGYW

SEQ ID NO: 14310 - protein, 8 aa, Artificial Sequence
  Synthetic Peptide encoding a CDR
GYTFTSYW

SEQ ID NO: 14311 - protein, 8 aa, Artificial Sequence
  Synthetic Peptide encoding a CDR
GYTFTDHI

SEQ ID NO: 14312 - protein, 8 aa, Artificial Sequence
  Synthetic Peptide encoding a CDR
GFTFSDYN

SEQ ID NO: 14313 - protein, 8 aa, Artificial Sequence
  Synthetic Peptide encoding a CDR
GFSLTSYH

SEQ ID NO: 14314 - protein, 8 aa, Artificial Sequence
  Synthetic Peptide encoding a CDR
GYRIKDFL

SEQ ID NO: 14315 - protein, 8 aa, Artificial Sequence
  Synthetic Peptide encoding a CDR
GFTFSSSW

SEQ ID NO: 14316 - protein, 8 aa, Artificial Sequence
  Synthetic Peptide encoding a CDR
GYSFSSSW

SEQ ID NO: 14317 - protein, 8 aa, Artificial Sequence
  Synthetic Peptide encoding a CDR
GYTFTSYV

SEQ ID NO: 14318 - protein, 8 aa, Artificial Sequence
  Synthetic Peptide encoding a CDR
GYAFSSYW

SEQ ID NO: 14319 - protein, 8 aa, Artificial Sequence
  Synthetic Peptide encoding a CDR
GYAFSSSW

SEQ ID NO: 14320 - protein, 8 aa, Artificial Sequence
  Synthetic Peptide encoding a CDR
GYAFSSYW

SEQ ID NO: 14321 - protein, 8 aa, Artificial Sequence
  Synthetic Peptide encoding a CDR
GYTFTSNW

SEQ ID NO: 14322 - protein, 8 aa, Artificial Sequence
  Synthetic Peptide encoding a CDR
GYAFSSYW

SEQ ID NO: 14323 - protein, 8 aa, Artificial Sequence
  Synthetic Peptide encoding a CDR
GYAFSSYW

SEQ ID NO: 14324 - protein, 8 aa, Artificial Sequence
  Synthetic Peptide encoding a CDR
GYTFTSYN

SEQ ID NO: 14325 - protein, 8 aa, Artificial Sequence
  Synthetic Peptide encoding a CDR
GFTFSYHA

SEQ ID NO: 14326 - protein, 8 aa, Artificial Sequence
  Synthetic Peptide encoding a CDR
GFTFGDYT

SEQ ID NO: 14327 - protein, 8 aa, Artificial Sequence
  Synthetic Peptide encoding a CDR
GYTFTSYN

SEQ ID NO: 14328 - protein, 8 aa, Artificial Sequence
  Synthetic Peptide encoding a CDR
GYTFTSYN

SEQ ID NO: 14329 - protein, 8 aa, Artificial Sequence
  Synthetic Peptide encoding a CDR
GYTFTNFG

SEQ ID NO: 14330 - protein, 8 aa, Artificial Sequence
  Synthetic Peptide encoding a CDR
GYTFTSYN

SEQ ID NO: 14331 - protein, 8 aa, Artificial Sequence
  Synthetic Peptide encoding a CDR
GYTFTSYN

SEQ ID NO: 14332 - protein, 8 aa, Artificial Sequence
  Synthetic Peptide encoding a CDR
GFTFHDYA

SEQ ID NO: 14333 - protein, 8 aa, Artificial Sequence
  Synthetic Peptide encoding a CDR
GRTFTSYN

SEQ ID NO: 14334 - protein, 8 aa, Artificial Sequence
  Synthetic Peptide encoding a CDR
GGTFSDYA

SEQ ID NO: 14335 - protein, 8 aa, Artificial Sequence
  Synthetic Peptide encoding a CDR
GYSFTDYN

SEQ ID NO: 14336 - protein, 8 aa, Artificial Sequence
  Synthetic Peptide encoding a CDR
GYTFTNYD

SEQ ID NO: 14337 - protein, 8 aa, Artificial Sequence
  Synthetic Peptide encoding a CDR
GGIFSNHA

SEQ ID NO: 14338 - protein, 8 aa, Artificial Sequence
  Synthetic Peptide encoding a CDR
GYTFTTFP

SEQ ID NO: 14339 - protein, 8 aa, Artificial Sequence
  Synthetic Peptide encoding a CDR
GYTFTTFP

SEQ ID NO: 14340 - protein, 8 aa, Artificial Sequence
  Synthetic Peptide encoding a CDR
GFTISGNY

SEQ ID NO: 14341 - protein, 8 aa, Artificial Sequence
  Synthetic Peptide encoding a CDR
GYTFKDTY

SEQ ID NO: 14342 - protein, 8 aa, Artificial Sequence
  Synthetic Peptide encoding a CDR
GYTFTDYY

SEQ ID NO: 14343 - protein, 8 aa, Artificial Sequence
  Synthetic Peptide encoding a CDR
GYSFTDYY

SEQ ID NO: 14344 - protein, 9 aa, Artificial Sequence
  Synthetic Peptide encoding a CDR
GYSITSAYY

SEQ ID NO: 14345 - protein, 9 aa, Artificial Sequence
  Synthetic Peptide encoding a CDR
GYSITSAYY

SEQ ID NO: 14346 - protein, 8 aa, Artificial Sequence
  Synthetic Peptide encoding a CDR
GYAFSSSW

SEQ ID NO: 14347 - protein, 8 aa, Artificial Sequence
  Synthetic Peptide encoding a CDR
GFTFSDYY

SEQ ID NO: 14348 - protein, 8 aa, Artificial Sequence
  Synthetic Peptide encoding a CDR
GFTFSDYY

SEQ ID NO: 14349 - protein, 8 aa, Artificial Sequence
  Synthetic Peptide encoding a CDR
GFTFSDYY

SEQ ID NO: 14350 - protein, 8 aa, Artificial Sequence
  Synthetic Peptide encoding a CDR
GYTFTSYW

SEQ ID NO: 14351 - protein, 8 aa, Artificial Sequence
  Synthetic Peptide encoding a CDR
GYAFSSSW

SEQ ID NO: 14352 - protein, 8 aa, Artificial Sequence
  Synthetic Peptide encoding a CDR
GFTFGHYW

SEQ ID NO: 14353 - protein, 8 aa, Artificial Sequence
  Synthetic Peptide encoding a CDR
GFTFGSFS

SEQ ID NO: 14354 - protein, 8 aa, Artificial Sequence
  Synthetic Peptide encoding a CDR
GFSFSGTA

SEQ ID NO: 14355 - protein, 8 aa, Artificial Sequence
  Synthetic Peptide encoding a CDR
GFTFSSYA

SEQ ID NO: 14356 - protein, 8 aa, Artificial Sequence
  Synthetic Peptide encoding a CDR
GVTLSDYG

SEQ ID NO: 14357 - protein, 8 aa, Artificial Sequence
  Synthetic Peptide encoding a CDR
GGSFSGYY

SEQ ID NO: 14358 - protein, 8 aa, Artificial Sequence
  Synthetic Peptide encoding a CDR
GGTFSSYA

SEQ ID NO: 14359 - protein, 8 aa, Artificial Sequence
  Synthetic Peptide encoding a CDR
GGSFNNYP

SEQ ID NO: 14360 - protein, 8 aa, Artificial Sequence
  Synthetic Peptide encoding a CDR
GYTFTDHA

SEQ ID NO: 14361 - protein, 8 aa, Artificial Sequence
  Synthetic Peptide encoding a CDR
GYTFTDFY

SEQ ID NO: 14362 - protein, 8 aa, Artificial Sequence
  Synthetic Peptide encoding a CDR
GFTFSSYG

SEQ ID NO: 14363 - protein, 8 aa, Artificial Sequence
  Synthetic Peptide encoding a CDR
GFTFSTYL

SEQ ID NO: 14364 - protein, 8 aa, Artificial Sequence
  Synthetic Peptide encoding a CDR
GYSFTSYW

SEQ ID NO: 14365 - protein, 8 aa, Artificial Sequence
  Synthetic Peptide encoding a CDR
GGTFSSYT

SEQ ID NO: 14366 - protein, 8 aa, Artificial Sequence
  Synthetic Peptide encoding a CDR
GYTFTAYY

SEQ ID NO: 14367 - protein, 8 aa, Artificial Sequence
  Synthetic Peptide encoding a CDR
GYTFSSYW

SEQ ID NO: 14368 - protein, 8 aa, Artificial Sequence
  Synthetic Peptide encoding a CDR
GYTFTSYW

SEQ ID NO: 14369 - protein, 8 aa, Artificial Sequence
  Synthetic Peptide encoding a CDR
GYTFNGYF

SEQ ID NO: 14370 - protein, 8 aa, Artificial Sequence
  Synthetic Peptide encoding a CDR
GYTFTSYV

SEQ ID NO: 14371 - protein, 8 aa, Artificial Sequence
  Synthetic Peptide encoding a CDR
GDTFSSYY

SEQ ID NO: 14372 - protein, 8 aa, Artificial Sequence
  Synthetic Peptide encoding a CDR
GFTLSSYY

SEQ ID NO: 14373 - protein, 8 aa, Artificial Sequence
  Synthetic Peptide encoding a CDR
GYTFTNYY

SEQ ID NO: 14374 - protein, 8 aa, Artificial Sequence
  Synthetic Peptide encoding a CDR
GYTFTHYS

SEQ ID NO: 14375 - protein, 8 aa, Artificial Sequence
  Synthetic Peptide encoding a CDR
GYTFRHYS

SEQ ID NO: 14376 - protein, 9 aa, Artificial Sequence
  Synthetic Peptide encoding a CDR
GYSITSDYT

SEQ ID NO: 14377 - protein, 8 aa, Artificial Sequence
  Synthetic Peptide encoding a CDR
GFTFSSYT

SEQ ID NO: 14378 - protein, 8 aa, Artificial Sequence
  Synthetic Peptide encoding a CDR
GFTFDDYA

SEQ ID NO: 14379 - protein, 10 aa, Artificial Sequence
  Synthetic Peptide encoding a CDR
GDSVLSNSDT

SEQ ID NO: 14380 - protein, 8 aa, Artificial Sequence
  Synthetic Peptide encoding a CDR
GYTFTSYD

SEQ ID NO: 14381 - protein, 10 aa, Artificial Sequence
  Synthetic Peptide encoding a CDR
GDSVSSNSAA

SEQ ID NO: 14382 - protein, 10 aa, Artificial Sequence
  Synthetic Peptide encoding a CDR
GDSMLSNSDT

SEQ ID NO: 14383 - protein, 8 aa, Artificial Sequence
  Synthetic Peptide encoding a CDR
GVSLPDYG

SEQ ID NO: 14384 - protein, 8 aa, Artificial Sequence
  Synthetic Peptide encoding a CDR
GFSFNTYA

SEQ ID NO: 14385 - protein, 9 aa, Artificial Sequence
  Synthetic Peptide encoding a CDR
GYSITIDYT

SEQ ID NO: 14386 - protein, 8 aa, Artificial Sequence
  Synthetic Peptide encoding a CDR
GFTFSNFE

SEQ ID NO: 14387 - protein, 8 aa, Artificial Sequence
  Synthetic Peptide encoding a CDR
GFTFSTYG

SEQ ID NO: 14388 - protein, 8 aa, Artificial Sequence
  Synthetic Peptide encoding a CDR
GYSFTGYN

SEQ ID NO: 14389 - protein, 8 aa, Artificial Sequence
  Synthetic Peptide encoding a CDR
GYSFTGYN

SEQ ID NO: 14390 - protein, 8 aa, Artificial Sequence
  Synthetic Peptide encoding a CDR
GFTFSSYA

SEQ ID NO: 14391 - protein, 8 aa, Artificial Sequence
  Synthetic Peptide encoding a CDR
GFTFSSYA

SEQ ID NO: 14392 - protein, 8 aa, Artificial Sequence
  Synthetic Peptide encoding a CDR
GFTFSTYA

SEQ ID NO: 14393 - protein, 8 aa, Artificial Sequence
  Synthetic Peptide encoding a CDR
GFTFSSYA

SEQ ID NO: 14394 - protein, 8 aa, Artificial Sequence
  Synthetic Peptide encoding a CDR
GFTFSSYI

SEQ ID NO: 14395 - protein, 10 aa, Artificial Sequence
  Synthetic Peptide encoding a CDR
GGSVSSDYYY

SEQ ID NO: 14396 - protein, 8 aa, Artificial Sequence
  Synthetic Peptide encoding a CDR
GFTFGYYA

SEQ ID NO: 14397 - protein, 8 aa, Artificial Sequence
  Synthetic Peptide encoding a CDR
GFTFSSYA

SEQ ID NO: 14398 - protein, 8 aa, Artificial Sequence
  Synthetic Peptide encoding a CDR
GFTFSSYA

SEQ ID NO: 14399 - protein, 9 aa, Artificial Sequence
  Synthetic Peptide encoding a CDR
GYDFIDYVI

SEQ ID NO: 14400 - protein, 9 aa, Artificial Sequence
  Synthetic Peptide encoding a CDR
GYRFPDYII

SEQ ID NO: 14401 - protein, 8 aa, Artificial Sequence
  Synthetic Peptide encoding a CDR
GYTFTDYL

SEQ ID NO: 14402 - protein, 8 aa, Artificial Sequence
  Synthetic Peptide encoding a CDR
GYRFTNYF

SEQ ID NO: 14403 - protein, 8 aa, Artificial Sequence
  Synthetic Peptide encoding a CDR
GYRFTNYF

SEQ ID NO: 14404 - protein, 9 aa, Artificial Sequence
  Synthetic Peptide encoding a CDR
GYKFMDQLI

SEQ ID NO: 14405 - protein, 8 aa, Artificial Sequence
  Synthetic Peptide encoding a CDR
GYTFVDSF

SEQ ID NO: 14406 - protein, 8 aa, Artificial Sequence
  Synthetic Peptide encoding a CDR
GYKFSDSL

SEQ ID NO: 14407 - protein, 10 aa, Artificial Sequence
  Synthetic Peptide encoding a CDR
GGSISSGGYH

SEQ ID NO: 14408 - protein, 10 aa, Artificial Sequence
  Synthetic Peptide encoding a CDR
GGSISSGGYH

SEQ ID NO: 14409 - protein, 8 aa, Artificial Sequence
  Synthetic Peptide encoding a CDR
GDSVTGYY

SEQ ID NO: 14410 - protein, 8 aa, Artificial Sequence
  Synthetic Peptide encoding a CDR
GGTFSSHV

SEQ ID NO: 14411 - protein, 8 aa, Artificial Sequence
  Synthetic Peptide encoding a CDR
GGTFYSYS

SEQ ID NO: 14412 - protein, 8 aa, Artificial Sequence
  Synthetic Peptide encoding a CDR
GGTFYSYS

SEQ ID NO: 14413 - protein, 8 aa, Artificial Sequence
  Synthetic Peptide encoding a CDR
GGTFESYS

SEQ ID NO: 14414 - protein, 8 aa, Artificial Sequence
  Synthetic Peptide encoding a CDR
GGTFDSYS

SEQ ID NO: 14415 - protein, 8 aa, Artificial Sequence
  Synthetic Peptide encoding a CDR
GGIFSDFS

SEQ ID NO: 14416 - protein, 8 aa, Artificial Sequence
  Synthetic Peptide encoding a CDR
GYTFTDNW

SEQ ID NO: 14417 - protein, 8 aa, Artificial Sequence
  Synthetic Peptide encoding a CDR
GYTFTDNW

SEQ ID NO: 14418 - protein, 8 aa, Artificial Sequence
  Synthetic Peptide encoding a CDR
GFSLTSYG

SEQ ID NO: 14419 - protein, 8 aa, Artificial Sequence
  Synthetic Peptide encoding a CDR
GFTFSNYW

SEQ ID NO: 14420 - protein, 8 aa, Artificial Sequence
  Synthetic Peptide encoding a CDR
GYTFTDYS

SEQ ID NO: 14421 - protein, 8 aa, Artificial Sequence
  Synthetic Peptide encoding a CDR
GYTFTDYS

SEQ ID NO: 14422 - protein, 8 aa, Artificial Sequence
  Synthetic Peptide encoding a CDR
GYTFTDYS

SEQ ID NO: 14423 - protein, 8 aa, Artificial Sequence
  Synthetic Peptide encoding a CDR
GYTFTDYS

SEQ ID NO: 14424 - protein, 8 aa, Artificial Sequence
  Synthetic Peptide encoding a CDR
GYTFTDYS

SEQ ID NO: 14425 - protein, 8 aa, Artificial Sequence
  Synthetic Peptide encoding a CDR
GYTFTDYS

SEQ ID NO: 14426 - protein, 8 aa, Artificial Sequence
  Synthetic Peptide encoding a CDR
GYTFTDYS

SEQ ID NO: 14427 - protein, 8 aa, Artificial Sequence
  Synthetic Peptide encoding a CDR
GYTFNGYF

SEQ ID NO: 14428 - protein, 8 aa, Artificial Sequence
  Synthetic Peptide encoding a CDR
IYPGDGDT

SEQ ID NO: 14429 - protein, 7 aa, Artificial Sequence
  Synthetic Peptide encoding a CDR
IDPETGG

SEQ ID NO: 14430 - protein, 8 aa, Artificial Sequence
  Synthetic Peptide encoding a CDR
ISSGSSTI

SEQ ID NO: 14431 - protein, 8 aa, Artificial Sequence
  Synthetic Peptide encoding a CDR
INPNSGGT

SEQ ID NO: 14432 - protein, 8 aa, Artificial Sequence
  Synthetic Peptide encoding a CDR
IYPGDSDT

SEQ ID NO: 14433 - protein, 8 aa, Artificial Sequence
  Synthetic Peptide encoding a CDR
INTESGVP

SEQ ID NO: 14434 - protein, 8 aa, Artificial Sequence
  Synthetic Peptide encoding a CDR
TYRGHSDT

SEQ ID NO: 14435 - protein, 8 aa, Artificial Sequence
  Synthetic Peptide encoding a CDR
INPGNVNT

SEQ ID NO: 14436 - protein, 8 aa, Artificial Sequence
  Synthetic Peptide encoding a CDR
IIPSNGAT

SEQ ID NO: 14437 - protein, 8 aa, Artificial Sequence
  Synthetic Peptide encoding a CDR
ILPGTGRT

SEQ ID NO: 14438 - protein, 8 aa, Artificial Sequence
  Synthetic Peptide encoding a CDR
INPNNGGT

SEQ ID NO: 14439 - protein, 8 aa, Artificial Sequence
  Synthetic Peptide encoding a CDR
INPYNDGT

SEQ ID NO: 14440 - protein, 7 aa, Artificial Sequence
  Synthetic Peptide encoding a CDR
IWWDDDK

SEQ ID NO: 14441 - protein, 7 aa, Artificial Sequence
  Synthetic Peptide encoding a CDR
IWWDDDK

SEQ ID NO: 14442 - protein, 8 aa, Artificial Sequence
  Synthetic Peptide encoding a CDR
IWPGDGDT

SEQ ID NO: 14443 - protein, 7 aa, Artificial Sequence
  Synthetic Peptide encoding a CDR
IWGSETT

SEQ ID NO: 14444 - protein, 7 aa, Artificial Sequence
  Synthetic Peptide encoding a CDR
IWGSETT

SEQ ID NO: 14445 - protein, 7 aa, Artificial Sequence
  Synthetic Peptide encoding a CDR
IWGSETT

SEQ ID NO: 14446 - protein, 8 aa, Artificial Sequence
  Synthetic Peptide encoding a CDR
ISWNSGSI

SEQ ID NO: 14447 - protein, 8 aa, Artificial Sequence
  Synthetic Peptide encoding a CDR
IFPGDGDT

SEQ ID NO: 14448 - protein, 8 aa, Artificial Sequence
  Synthetic Peptide encoding a CDR
IYPGDGDT

SEQ ID NO: 14449 - protein, 8 aa, Artificial Sequence
  Synthetic Peptide encoding a CDR
IWGDGRTD

SEQ ID NO: 14450 - protein, 9 aa, Artificial Sequence
  Synthetic Peptide encoding a CDR
TYYRSKWYN

SEQ ID NO: 14451 - protein, 8 aa, Artificial Sequence
  Synthetic Peptide encoding a CDR
IIPILGTA

SEQ ID NO: 14452 - protein, 7 aa, Artificial Sequence
  Synthetic Peptide encoding a CDR
INHGGGT

SEQ ID NO: 14453 - protein, 8 aa, Artificial Sequence
  Synthetic Peptide encoding a CDR
IYPGSGNT

SEQ ID NO: 14454 - protein, 7 aa, Artificial Sequence
  Synthetic Peptide encoding a CDR
IGSGGGI

SEQ ID NO: 14455 - protein, 8 aa, Artificial Sequence
  Synthetic Peptide encoding a CDR
ITTRSSTI

SEQ ID NO: 14456 - protein, 7 aa, Artificial Sequence
  Synthetic Peptide encoding a CDR
ISYSGHT

SEQ ID NO: 14457 - protein, 8 aa, Artificial Sequence
  Synthetic Peptide encoding a CDR
IYPGNDDI

SEQ ID NO: 14458 - protein, 8 aa, Artificial Sequence
  Synthetic Peptide encoding a CDR
INTYTGEP

SEQ ID NO: 14459 - protein, 8 aa, Artificial Sequence
  Synthetic Peptide encoding a CDR
INTNTGEP

SEQ ID NO: 14460 - protein, 8 aa, Artificial Sequence
  Synthetic Peptide encoding a CDR
ISSGGSYT

SEQ ID NO: 14461 - protein, 8 aa, Artificial Sequence
  Synthetic Peptide encoding a CDR
IDPYYGDT

SEQ ID NO: 14462 - protein, 8 aa, Artificial Sequence
  Synthetic Peptide encoding a CDR
IDPYYGDT

SEQ ID NO: 14463 - protein, 8 aa, Artificial Sequence
  Synthetic Peptide encoding a CDR
INTYTGEP

SEQ ID NO: 14464 - protein, 8 aa, Artificial Sequence
  Synthetic Peptide encoding a CDR
IDPSDSET

SEQ ID NO: 14465 - protein, 8 aa, Artificial Sequence
  Synthetic Peptide encoding a CDR
ILPGGGDT

SEQ ID NO: 14466 - protein, 8 aa, Artificial Sequence
  Synthetic Peptide encoding a CDR
IYPRDGIT

SEQ ID NO: 14467 - protein, 7 aa, Artificial Sequence
  Synthetic Peptide encoding a CDR
IYYSGST

SEQ ID NO: 14468 - protein, 8 aa, Artificial Sequence
  Synthetic Peptide encoding a CDR
IRSSGSST

SEQ ID NO: 14469 - protein, 8 aa, Artificial Sequence
  Synthetic Peptide encoding a CDR
ISGSGSNT

SEQ ID NO: 14470 - protein, 8 aa, Artificial Sequence
  Synthetic Peptide encoding a CDR
FYPGSGSI

SEQ ID NO: 14471 - protein, 8 aa, Artificial Sequence
  Synthetic Peptide encoding a CDR
ISSGSTTI

SEQ ID NO: 14472 - protein, 8 aa, Artificial Sequence
  Synthetic Peptide encoding a CDR
INPYNDGS

SEQ ID NO: 14473 - protein, 8 aa, Artificial Sequence
  Synthetic Peptide encoding a CDR
INPYNDGT

SEQ ID NO: 14474 - protein, 7 aa, Artificial Sequence
  Synthetic Peptide encoding a CDR
IYYSGST

SEQ ID NO: 14475 - protein, 8 aa, Artificial Sequence
  Synthetic Peptide encoding a CDR
INTYTGEP

SEQ ID NO: 14476 - protein, 8 aa, Artificial Sequence
  Synthetic Peptide encoding a CDR
INPDSSTI

SEQ ID NO: 14477 - protein, 8 aa, Artificial Sequence
  Synthetic Peptide encoding a CDR
IHPSDSET

SEQ ID NO: 14478 - protein, 8 aa, Artificial Sequence
  Synthetic Peptide encoding a CDR
FDPEENEI

SEQ ID NO: 14479 - protein, 8 aa, Artificial Sequence
  Synthetic Peptide encoding a CDR
FDPEENEI

SEQ ID NO: 14480 - protein, 7 aa, Artificial Sequence
  Synthetic Peptide encoding a CDR
IWWDDVK

SEQ ID NO: 14481 - protein, 8 aa, Artificial Sequence
  Synthetic Peptide encoding a CDR
INTYTGEP

SEQ ID NO: 14482 - protein, 8 aa, Artificial Sequence
  Synthetic Peptide encoding a CDR
IAPPGLNT

SEQ ID NO: 14483 - protein, 7 aa, Artificial Sequence
  Synthetic Peptide encoding a CDR
IWSGGNT

SEQ ID NO: 14484 - protein, 8 aa, Artificial Sequence
  Synthetic Peptide encoding a CDR
INPTSGGS

SEQ ID NO: 14485 - protein, 8 aa, Artificial Sequence
  Synthetic Peptide encoding a CDR
ISGSGGST

SEQ ID NO: 14486 - protein, 8 aa, Artificial Sequence
  Synthetic Peptide encoding a CDR
IDPENDET

SEQ ID NO: 14487 - protein, 8 aa, Artificial Sequence
  Synthetic Peptide encoding a CDR
ISYDGSNK

SEQ ID NO: 14488 - protein, 8 aa, Artificial Sequence
  Synthetic Peptide encoding a CDR
IFPGSGNI

SEQ ID NO: 14489 - protein, 10 aa, Artificial Sequence
  Synthetic Peptide encoding a CDR
IRNKPYNYET

SEQ ID NO: 14490 - protein, 8 aa, Artificial Sequence
  Synthetic Peptide encoding a CDR
IIPIFGTA

SEQ ID NO: 14491 - protein, 8 aa, Artificial Sequence
  Synthetic Peptide encoding a CDR
IKPQYGAV

SEQ ID NO: 14492 - protein, 8 aa, Artificial Sequence
  Synthetic Peptide encoding a CDR
IHPYDGDT

SEQ ID NO: 14493 - protein, 8 aa, Artificial Sequence
  Synthetic Peptide encoding a CDR
ISAYNGHT

SEQ ID NO: 14494 - protein, 8 aa, Artificial Sequence
  Synthetic Peptide encoding a CDR
IDPYYGGT

SEQ ID NO: 14495 - protein, 8 aa, Artificial Sequence
  Synthetic Peptide encoding a CDR
IWAGGITN

SEQ ID NO: 14496 - protein, 8 aa, Artificial Sequence
  Synthetic Peptide encoding a CDR
ISSGGSGT

SEQ ID NO: 14497 - protein, 7 aa, Artificial Sequence
  Synthetic Peptide encoding a CDR
IDNAGTT

SEQ ID NO: 14498 - protein, 7 aa, Artificial Sequence
  Synthetic Peptide encoding a CDR
IGGSGDT

SEQ ID NO: 14499 - protein, 8 aa, Artificial Sequence
  Synthetic Peptide encoding a CDR
ISRSGRDI

SEQ ID NO: 14500 - protein, 8 aa, Artificial Sequence
  Synthetic Peptide encoding a CDR
ISRSGRDI

SEQ ID NO: 14501 - protein, 8 aa, Artificial Sequence
  Synthetic Peptide encoding a CDR
ISYDGSNK

SEQ ID NO: 14502 - protein, 8 aa, Artificial Sequence
  Synthetic Peptide encoding a CDR
ISSGGSYT

SEQ ID NO: 14503 - protein, 8 aa, Artificial Sequence
  Synthetic Peptide encoding a CDR
LEPKTGDT

SEQ ID NO: 14504 - protein, 7 aa, Artificial Sequence
  Synthetic Peptide encoding a CDR
IYYSGST

SEQ ID NO: 14505 - protein, 8 aa, Artificial Sequence
  Synthetic Peptide encoding a CDR
INGRGSST

SEQ ID NO: 14506 - protein, 8 aa, Artificial Sequence
  Synthetic Peptide encoding a CDR
ISSSGSTI

SEQ ID NO: 14507 - protein, 8 aa, Artificial Sequence
  Synthetic Peptide encoding a CDR
IYPTNGYT

SEQ ID NO: 14508 - protein, 8 aa, Artificial Sequence
  Synthetic Peptide encoding a CDR
ISSSGSTI

SEQ ID NO: 14509 - protein, 8 aa, Artificial Sequence
  Synthetic Peptide encoding a CDR
INPKTGQP

SEQ ID NO: 14510 - protein, 13 aa, Artificial Sequence
  Synthetic Peptide encoding a CDR
LSHCASYWNRGWT

SEQ ID NO: 14511 - protein, 8 aa, Artificial Sequence
  Synthetic Peptide encoding a CDR
LKPRGGAV

SEQ ID NO: 14512 - protein, 8 aa, Artificial Sequence
  Synthetic Peptide encoding a CDR
IIPIFGTS

SEQ ID NO: 14513 - protein, 10 aa, Artificial Sequence
  Synthetic Peptide encoding a CDR
IRLKSNNFAR

SEQ ID NO: 14514 - protein, 8 aa, Artificial Sequence
  Synthetic Peptide encoding a CDR
IIPIFGTA

SEQ ID NO: 14515 - protein, 8 aa, Artificial Sequence
  Synthetic Peptide encoding a CDR
ISYDGSNK

SEQ ID NO: 14516 - protein, 8 aa, Artificial Sequence
  Synthetic Peptide encoding a CDR
IVPWGDFT

SEQ ID NO: 14517 - protein, 8 aa, Artificial Sequence
  Synthetic Peptide encoding a CDR
VKWAGGST

SEQ ID NO: 14518 - protein, 8 aa, Artificial Sequence
  Synthetic Peptide encoding a CDR
VSSGGSYI

SEQ ID NO: 14519 - protein, 7 aa, Artificial Sequence
  Synthetic Peptide encoding a CDR
ISYSGIT

SEQ ID NO: 14520 - protein, 9 aa, Artificial Sequence
  Synthetic Peptide encoding a CDR
TYYRSGWYN

SEQ ID NO: 14521 - protein, 8 aa, Artificial Sequence
  Synthetic Peptide encoding a CDR
IYPENSDT

SEQ ID NO: 14522 - protein, 8 aa, Artificial Sequence
  Synthetic Peptide encoding a CDR
INTYTGEP

SEQ ID NO: 14523 - protein, 8 aa, Artificial Sequence
  Synthetic Peptide encoding a CDR
INPRNDRT

SEQ ID NO: 14524 - protein, 8 aa, Artificial Sequence
  Synthetic Peptide encoding a CDR
IYPGNGDA

SEQ ID NO: 14525 - protein, 8 aa, Artificial Sequence
  Synthetic Peptide encoding a CDR
INPGSGGT

SEQ ID NO: 14526 - protein, 8 aa, Artificial Sequence
  Synthetic Peptide encoding a CDR
MSNVGAIT

SEQ ID NO: 14527 - protein, 7 aa, Artificial Sequence
  Synthetic Peptide encoding a CDR
IWSDGST

SEQ ID NO: 14528 - protein, 10 aa, Artificial Sequence
  Synthetic Peptide encoding a CDR
IRFKSHNYAT

SEQ ID NO: 14529 - protein, 8 aa, Artificial Sequence
  Synthetic Peptide encoding a CDR
IIPILGIA

SEQ ID NO: 14530 - protein, 7 aa, Artificial Sequence
  Synthetic Peptide encoding a CDR
IYYSGST

SEQ ID NO: 14531 - protein, 7 aa, Artificial Sequence
  Synthetic Peptide encoding a CDR
IYYSGST

SEQ ID NO: 14532 - protein, 7 aa, Artificial Sequence
  Synthetic Peptide encoding a CDR
IYYSGST

SEQ ID NO: 14533 - protein, 7 aa, Artificial Sequence
  Synthetic Peptide encoding a CDR
ITYSGST

SEQ ID NO: 14534 - protein, 7 aa, Artificial Sequence
  Synthetic Peptide encoding a CDR
ITYSGST

SEQ ID NO: 14535 - protein, 7 aa, Artificial Sequence
  Synthetic Peptide encoding a CDR
ITYSGST

SEQ ID NO: 14536 - protein, 10 aa, Artificial Sequence
  Synthetic Peptide encoding a CDR
IRSKSNNFAT

SEQ ID NO: 14537 - protein, 8 aa, Artificial Sequence
  Synthetic Peptide encoding a CDR
IYPGDGEN

SEQ ID NO: 14538 - protein, 8 aa, Artificial Sequence
  Synthetic Peptide encoding a CDR
IYPGDGET

SEQ ID NO: 14539 - protein, 7 aa, Artificial Sequence
  Synthetic Peptide encoding a CDR
IYYSGST

SEQ ID NO: 14540 - protein, 8 aa, Artificial Sequence
  Synthetic Peptide encoding a CDR
ISSGSSTI

SEQ ID NO: 14541 - protein, 8 aa, Artificial Sequence
  Synthetic Peptide encoding a CDR
IIPIFGTA

SEQ ID NO: 14542 - protein, 8 aa, Artificial Sequence
  Synthetic Peptide encoding a CDR
IIPIFGTA

SEQ ID NO: 14543 - protein, 8 aa, Artificial Sequence
  Synthetic Peptide encoding a CDR
ISSAGGYI

SEQ ID NO: 14544 - protein, 7 aa, Artificial Sequence
  Synthetic Peptide encoding a CDR
ISYSGSA

SEQ ID NO: 14545 - protein, 7 aa, Artificial Sequence
  Synthetic Peptide encoding a CDR
IHYSGDT

SEQ ID NO: 14546 - protein, 8 aa, Artificial Sequence
  Synthetic Peptide encoding a CDR
IVSSGGST

SEQ ID NO: 14547 - protein, 8 aa, Artificial Sequence
  Synthetic Peptide encoding a CDR
ILSSGGET

SEQ ID NO: 14548 - protein, 8 aa, Artificial Sequence
  Synthetic Peptide encoding a CDR
IWYDGSNK

SEQ ID NO: 14549 - protein, 7 aa, Artificial Sequence
  Synthetic Peptide encoding a CDR
IYDGSKR

SEQ ID NO: 14550 - protein, 8 aa, Artificial Sequence
  Synthetic Peptide encoding a CDR
ISPYGGST

SEQ ID NO: 14551 - protein, 7 aa, Artificial Sequence
  Synthetic Peptide encoding a CDR
INKDASA

SEQ ID NO: 14552 - protein, 8 aa, Artificial Sequence
  Synthetic Peptide encoding a CDR
ISSGGSYT

SEQ ID NO: 14553 - protein, 7 aa, Artificial Sequence
  Synthetic Peptide encoding a CDR
IYYNGNT

SEQ ID NO: 14554 - protein, 7 aa, Artificial Sequence
  Synthetic Peptide encoding a CDR
INHSGST

SEQ ID NO: 14555 - protein, 8 aa, Artificial Sequence
  Synthetic Peptide encoding a CDR
IWYDGSNK

SEQ ID NO: 14556 - protein, 8 aa, Artificial Sequence
  Synthetic Peptide encoding a CDR
INPNNGGT

SEQ ID NO: 14557 - protein, 7 aa, Artificial Sequence
  Synthetic Peptide encoding a CDR
IWWDDDK

SEQ ID NO: 14558 - protein, 8 aa, Artificial Sequence
  Synthetic Peptide encoding a CDR
ISTYYGDV

SEQ ID NO: 14559 - protein, 7 aa, Artificial Sequence
  Synthetic Peptide encoding a CDR
ISRGGTT

SEQ ID NO: 14560 - protein, 8 aa, Artificial Sequence
  Synthetic Peptide encoding a CDR
INPYNDGT

SEQ ID NO: 14561 - protein, 8 aa, Artificial Sequence
  Synthetic Peptide encoding a CDR
INWNSGRI

SEQ ID NO: 14562 - protein, 8 aa, Artificial Sequence
  Synthetic Peptide encoding a CDR
ISYDGSNK

SEQ ID NO: 14563 - protein, 7 aa, Artificial Sequence
  Synthetic Peptide encoding a CDR
IWAGGST

SEQ ID NO: 14564 - protein, 8 aa, Artificial Sequence
  Synthetic Peptide encoding a CDR
ISYDGSNK

SEQ ID NO: 14565 - protein, 8 aa, Artificial Sequence
  Synthetic Peptide encoding a CDR
INPYNDDI

SEQ ID NO: 14566 - protein, 8 aa, Artificial Sequence
  Synthetic Peptide encoding a CDR
INPNSGGT

SEQ ID NO: 14567 - protein, 8 aa, Artificial Sequence
  Synthetic Peptide encoding a CDR
ISGSGGST

SEQ ID NO: 14568 - protein, 8 aa, Artificial Sequence
  Synthetic Peptide encoding a CDR
FNPYNGET

SEQ ID NO: 14569 - protein, 8 aa, Artificial Sequence
  Synthetic Peptide encoding a CDR
ISYDGSNK

SEQ ID NO: 14570 - protein, 8 aa, Artificial Sequence
  Synthetic Peptide encoding a CDR
INVGNGNA

SEQ ID NO: 14571 - protein, 7 aa, Artificial Sequence
  Synthetic Peptide encoding a CDR
FYYGEKT

SEQ ID NO: 14572 - protein, 8 aa, Artificial Sequence
  Synthetic Peptide encoding a CDR
IWYDGSNK

SEQ ID NO: 14573 - protein, 8 aa, Artificial Sequence
  Synthetic Peptide encoding a CDR
MNPGSGET

SEQ ID NO: 14574 - protein, 8 aa, Artificial Sequence
  Synthetic Peptide encoding a CDR
FSPGNGDI

SEQ ID NO: 14575 - protein, 8 aa, Artificial Sequence
  Synthetic Peptide encoding a CDR
FSPGNTDI

SEQ ID NO: 14576 - protein, 8 aa, Artificial Sequence
  Synthetic Peptide encoding a CDR
INTKTGEP

SEQ ID NO: 14577 - protein, 7 aa, Artificial Sequence
  Synthetic Peptide encoding a CDR
IWTSGVT

SEQ ID NO: 14578 - protein, 7 aa, Artificial Sequence
  Synthetic Peptide encoding a CDR
TYSGGST

SEQ ID NO: 14579 - protein, 8 aa, Artificial Sequence
  Synthetic Peptide encoding a CDR
IYPGDSDT

SEQ ID NO: 14580 - protein, 8 aa, Artificial Sequence
  Synthetic Peptide encoding a CDR
INPYNGGT

SEQ ID NO: 14581 - protein, 7 aa, Artificial Sequence
  Synthetic Peptide encoding a CDR
IGYNSKT

SEQ ID NO: 14582 - protein, 8 aa, Artificial Sequence
  Synthetic Peptide encoding a CDR
ISYDGSNK

SEQ ID NO: 14583 - protein, 7 aa, Artificial Sequence
  Synthetic Peptide encoding a CDR
IYHSGST

SEQ ID NO: 14584 - protein, 8 aa, Artificial Sequence
  Synthetic Peptide encoding a CDR
ISYDGSNK

SEQ ID NO: 14585 - protein, 9 aa, Artificial Sequence
  Synthetic Peptide encoding a CDR
TYYRSKWNH

SEQ ID NO: 14586 - protein, 8 aa, Artificial Sequence
  Synthetic Peptide encoding a CDR
VDPGYSYS

SEQ ID NO: 14587 - protein, 8 aa, Artificial Sequence
  Synthetic Peptide encoding a CDR
IYPGYSDI

SEQ ID NO: 14588 - protein, 8 aa, Artificial Sequence
  Synthetic Peptide encoding a CDR
IIPIFGTA

SEQ ID NO: 14589 - protein, 8 aa, Artificial Sequence
  Synthetic Peptide encoding a CDR
INWNGGST

SEQ ID NO: 14590 - protein, 8 aa, Artificial Sequence
  Synthetic Peptide encoding a CDR
INWNGGST

SEQ ID NO: 14591 - protein, 8 aa, Artificial Sequence
  Synthetic Peptide encoding a CDR
ISSGSSTL

SEQ ID NO: 14592 - protein, 8 aa, Artificial Sequence
  Synthetic Peptide encoding a CDR
INTYTGES

SEQ ID NO: 14593 - protein, 8 aa, Artificial Sequence
  Synthetic Peptide encoding a CDR
ISYDGTNE

SEQ ID NO: 14594 - protein, 8 aa, Artificial Sequence
  Synthetic Peptide encoding a CDR
INAGNGNT

SEQ ID NO: 14595 - protein, 8 aa, Artificial Sequence
  Synthetic Peptide encoding a CDR
IYPYNGVS

SEQ ID NO: 14596 - protein, 7 aa, Artificial Sequence
  Synthetic Peptide encoding a CDR
IHYSGST

SEQ ID NO: 14597 - protein, 8 aa, Artificial Sequence
  Synthetic Peptide encoding a CDR
IDPSDSYT

SEQ ID NO: 14598 - protein, 8 aa, Artificial Sequence
  Synthetic Peptide encoding a CDR
IYPGGGYT

SEQ ID NO: 14599 - protein, 7 aa, Artificial Sequence
  Synthetic Peptide encoding a CDR
ITYDGST

SEQ ID NO: 14600 - protein, 8 aa, Artificial Sequence
  Synthetic Peptide encoding a CDR
ISSSGDPT

SEQ ID NO: 14601 - protein, 7 aa, Artificial Sequence
  Synthetic Peptide encoding a CDR
INHRGNT

SEQ ID NO: 14602 - protein, 8 aa, Artificial Sequence
  Synthetic Peptide encoding a CDR
ISGSGGRT

SEQ ID NO: 14603 - protein, 7 aa, Artificial Sequence
  Synthetic Peptide encoding a CDR
INYGGST

SEQ ID NO: 14604 - protein, 8 aa, Artificial Sequence
  Synthetic Peptide encoding a CDR
IDPGDSYT

SEQ ID NO: 14605 - protein, 10 aa, Artificial Sequence
  Synthetic Peptide encoding a CDR
IRSKAYGGTT

SEQ ID NO: 14606 - protein, 8 aa, Artificial Sequence
  Synthetic Peptide encoding a CDR
ISWNSGSI

SEQ ID NO: 14607 - protein, 8 aa, Artificial Sequence
  Synthetic Peptide encoding a CDR
IIPILGIA

SEQ ID NO: 14608 - protein, 8 aa, Artificial Sequence
  Synthetic Peptide encoding a CDR
INTETREP

SEQ ID NO: 14609 - protein, 8 aa, Artificial Sequence
  Synthetic Peptide encoding a CDR
INTETGEP

SEQ ID NO: 14610 - protein, 8 aa, Artificial Sequence
  Synthetic Peptide encoding a CDR
IIPSNGAT

SEQ ID NO: 14611 - protein, 8 aa, Artificial Sequence
  Synthetic Peptide encoding a CDR
IIPSNGAT

SEQ ID NO: 14612 - protein, 9 aa, Artificial Sequence
  Synthetic Peptide encoding a CDR
IIDPSDSDT

SEQ ID NO: 14613 - protein, 7 aa, Artificial Sequence
  Synthetic Peptide encoding a CDR
IQNAGIT

SEQ ID NO: 14614 - protein, 8 aa, Artificial Sequence
  Synthetic Peptide encoding a CDR
INPYSDGT

SEQ ID NO: 14615 - protein, 8 aa, Artificial Sequence
  Synthetic Peptide encoding a CDR
IRSDGSSK

SEQ ID NO: 14616 - protein, 8 aa, Artificial Sequence
  Synthetic Peptide encoding a CDR
IDPYDSET

SEQ ID NO: 14617 - protein, 8 aa, Artificial Sequence
  Synthetic Peptide encoding a CDR
INPYSGGA

SEQ ID NO: 14618 - protein, 8 aa, Artificial Sequence
  Synthetic Peptide encoding a CDR
ILYDGGRT

SEQ ID NO: 14619 - protein, 7 aa, Artificial Sequence
  Synthetic Peptide encoding a CDR
MWSDGDT

SEQ ID NO: 14620 - protein, 8 aa, Artificial Sequence
  Synthetic Peptide encoding a CDR
IDPEDGET

SEQ ID NO: 14621 - protein, 8 aa, Artificial Sequence
  Synthetic Peptide encoding a CDR
IYPGDGDT

SEQ ID NO: 14622 - protein, 8 aa, Artificial Sequence
  Synthetic Peptide encoding a CDR
IYPDDSDT

SEQ ID NO: 14623 - protein, 8 aa, Artificial Sequence
  Synthetic Peptide encoding a CDR
INPYNDGT

SEQ ID NO: 14624 - protein, 8 aa, Artificial Sequence
  Synthetic Peptide encoding a CDR
IWPGDGDT

SEQ ID NO: 14625 - protein, 8 aa, Artificial Sequence
  Synthetic Peptide encoding a CDR
IYPGDGDT

SEQ ID NO: 14626 - protein, 8 aa, Artificial Sequence
  Synthetic Peptide encoding a CDR
IYPGDGDT

SEQ ID NO: 14627 - protein, 8 aa, Artificial Sequence
  Synthetic Peptide encoding a CDR
IDPSDSYT

SEQ ID NO: 14628 - protein, 8 aa, Artificial Sequence
  Synthetic Peptide encoding a CDR
IYPGDGDT

SEQ ID NO: 14629 - protein, 8 aa, Artificial Sequence
  Synthetic Peptide encoding a CDR
IWPGDGDT

SEQ ID NO: 14630 - protein, 8 aa, Artificial Sequence
  Synthetic Peptide encoding a CDR
IYPGNGDT

SEQ ID NO: 14631 - protein, 7 aa, Artificial Sequence
  Synthetic Peptide encoding a CDR
IGTGGVT

SEQ ID NO: 14632 - protein, 8 aa, Artificial Sequence
  Synthetic Peptide encoding a CDR
ISWNSGSI

SEQ ID NO: 14633 - protein, 8 aa, Artificial Sequence
  Synthetic Peptide encoding a CDR
IYPGNGDT

SEQ ID NO: 14634 - protein, 8 aa, Artificial Sequence
  Synthetic Peptide encoding a CDR
IYPGNGDT

SEQ ID NO: 14635 - protein, 8 aa, Artificial Sequence
  Synthetic Peptide encoding a CDR
INTYTGEP

SEQ ID NO: 14636 - protein, 8 aa, Artificial Sequence
  Synthetic Peptide encoding a CDR
IYPGNGDT

SEQ ID NO: 14637 - protein, 8 aa, Artificial Sequence
  Synthetic Peptide encoding a CDR
IYPGNGDT

SEQ ID NO: 14638 - protein, 8 aa, Artificial Sequence
  Synthetic Peptide encoding a CDR
ISWNSGTI

SEQ ID NO: 14639 - protein, 8 aa, Artificial Sequence
  Synthetic Peptide encoding a CDR
IYPLTGDT

SEQ ID NO: 14640 - protein, 8 aa, Artificial Sequence
  Synthetic Peptide encoding a CDR
IIPILGVA

SEQ ID NO: 14641 - protein, 8 aa, Artificial Sequence
  Synthetic Peptide encoding a CDR
IDPYKGGT

SEQ ID NO: 14642 - protein, 8 aa, Artificial Sequence
  Synthetic Peptide encoding a CDR
IYPGDGST

SEQ ID NO: 14643 - protein, 8 aa, Artificial Sequence
  Synthetic Peptide encoding a CDR
IIPIFGTA

SEQ ID NO: 14644 - protein, 8 aa, Artificial Sequence
  Synthetic Peptide encoding a CDR
FHPYNDQT

SEQ ID NO: 14645 - protein, 8 aa, Artificial Sequence
  Synthetic Peptide encoding a CDR
FHPYNDQT

SEQ ID NO: 14646 - protein, 7 aa, Artificial Sequence
  Synthetic Peptide encoding a CDR
IYSGDST

SEQ ID NO: 14647 - protein, 8 aa, Artificial Sequence
  Synthetic Peptide encoding a CDR
IDPANGNT

SEQ ID NO: 14648 - protein, 8 aa, Artificial Sequence
  Synthetic Peptide encoding a CDR
VNPYNGGT

SEQ ID NO: 14649 - protein, 8 aa, Artificial Sequence
  Synthetic Peptide encoding a CDR
INPYNGAA

SEQ ID NO: 14650 - protein, 7 aa, Artificial Sequence
  Synthetic Peptide encoding a CDR
ISYDGRN

SEQ ID NO: 14651 - protein, 8 aa, Artificial Sequence
  Synthetic Peptide encoding a CDR
ISYDGRNN

SEQ ID NO: 14652 - protein, 8 aa, Artificial Sequence
  Synthetic Peptide encoding a CDR
IYPGDGDT

SEQ ID NO: 14653 - protein, 8 aa, Artificial Sequence
  Synthetic Peptide encoding a CDR
INYDGSST

SEQ ID NO: 14654 - protein, 8 aa, Artificial Sequence
  Synthetic Peptide encoding a CDR
INYDGEST

SEQ ID NO: 14655 - protein, 8 aa, Artificial Sequence
  Synthetic Peptide encoding a CDR
INYDGGST

SEQ ID NO: 14656 - protein, 8 aa, Artificial Sequence
  Synthetic Peptide encoding a CDR
IYPGDGDT

SEQ ID NO: 14657 - protein, 8 aa, Artificial Sequence
  Synthetic Peptide encoding a CDR
IYPGDGDT

SEQ ID NO: 14658 - protein, 10 aa, Artificial Sequence
  Synthetic Peptide encoding a CDR
FRNKPYNYET

SEQ ID NO: 14659 - protein, 8 aa, Artificial Sequence
  Synthetic Peptide encoding a CDR
LSARSSLT

SEQ ID NO: 14660 - protein, 8 aa, Artificial Sequence
  Synthetic Peptide encoding a CDR
ISSTGRST

SEQ ID NO: 14661 - protein, 8 aa, Artificial Sequence
  Synthetic Peptide encoding a CDR
ISGRGRST

SEQ ID NO: 14662 - protein, 8 aa, Artificial Sequence
  Synthetic Peptide encoding a CDR
IRNDGSDK

SEQ ID NO: 14663 - protein, 7 aa, Artificial Sequence
  Synthetic Peptide encoding a CDR
INHSGST

SEQ ID NO: 14664 - protein, 8 aa, Artificial Sequence
  Synthetic Peptide encoding a CDR
IIPIFGTA

SEQ ID NO: 14665 - protein, 8 aa, Artificial Sequence
  Synthetic Peptide encoding a CDR
IIPILGIT

SEQ ID NO: 14666 - protein, 8 aa, Artificial Sequence
  Synthetic Peptide encoding a CDR
FSPGNTDI

SEQ ID NO: 14667 - protein, 8 aa, Artificial Sequence
  Synthetic Peptide encoding a CDR
INPNIGDT

SEQ ID NO: 14668 - protein, 8 aa, Artificial Sequence
  Synthetic Peptide encoding a CDR
IWDDGSNK

SEQ ID NO: 14669 - protein, 7 aa, Artificial Sequence
  Synthetic Peptide encoding a CDR
IGSGGDT

SEQ ID NO: 14670 - protein, 8 aa, Artificial Sequence
  Synthetic Peptide encoding a CDR
IYPGDSDT

SEQ ID NO: 14671 - protein, 8 aa, Artificial Sequence
  Synthetic Peptide encoding a CDR
FIPISGTV

SEQ ID NO: 14672 - protein, 8 aa, Artificial Sequence
  Synthetic Peptide encoding a CDR
MNTNNGAT

SEQ ID NO: 14673 - protein, 8 aa, Artificial Sequence
  Synthetic Peptide encoding a CDR
ILPGSGST

SEQ ID NO: 14674 - protein, 8 aa, Artificial Sequence
  Synthetic Peptide encoding a CDR
IYPSDSYT

SEQ ID NO: 14675 - protein, 8 aa, Artificial Sequence
  Synthetic Peptide encoding a CDR
INPNNGDS

SEQ ID NO: 14676 - protein, 8 aa, Artificial Sequence
  Synthetic Peptide encoding a CDR
IYPYNDGT

SEQ ID NO: 14677 - protein, 8 aa, Artificial Sequence
  Synthetic Peptide encoding a CDR
IIPILGIA

SEQ ID NO: 14678 - protein, 8 aa, Artificial Sequence
  Synthetic Peptide encoding a CDR
INSNGGST

SEQ ID NO: 14679 - protein, 8 aa, Artificial Sequence
  Synthetic Peptide encoding a CDR
LNPNNGDT

SEQ ID NO: 14680 - protein, 8 aa, Artificial Sequence
  Synthetic Peptide encoding a CDR
INTETGEP

SEQ ID NO: 14681 - protein, 8 aa, Artificial Sequence
  Synthetic Peptide encoding a CDR
INTESGVP

SEQ ID NO: 14682 - protein, 7 aa, Artificial Sequence
  Synthetic Peptide encoding a CDR
ITYSGST

SEQ ID NO: 14683 - protein, 8 aa, Artificial Sequence
  Synthetic Peptide encoding a CDR
ISSGGGNT

SEQ ID NO: 14684 - protein, 8 aa, Artificial Sequence
  Synthetic Peptide encoding a CDR
ISWNSGSI

SEQ ID NO: 14685 - protein, 9 aa, Artificial Sequence
  Synthetic Peptide encoding a CDR
TYHRSTWYD

SEQ ID NO: 14686 - protein, 8 aa, Artificial Sequence
  Synthetic Peptide encoding a CDR
MNPNSGNT

SEQ ID NO: 14687 - protein, 9 aa, Artificial Sequence
  Synthetic Peptide encoding a CDR
TYYRSKWYS

SEQ ID NO: 14688 - protein, 9 aa, Artificial Sequence
  Synthetic Peptide encoding a CDR
TYHRSTWYD

SEQ ID NO: 14689 - protein, 7 aa, Artificial Sequence
  Synthetic Peptide encoding a CDR
IWGSETT

SEQ ID NO: 14690 - protein, 8 aa, Artificial Sequence
  Synthetic Peptide encoding a CDR
IRSKSNNF

SEQ ID NO: 14691 - protein, 7 aa, Artificial Sequence
  Synthetic Peptide encoding a CDR
ITYSGST

SEQ ID NO: 14692 - protein, 8 aa, Artificial Sequence
  Synthetic Peptide encoding a CDR
ISSNGRYI

SEQ ID NO: 14693 - protein, 8 aa, Artificial Sequence
  Synthetic Peptide encoding a CDR
INNGSGYI

SEQ ID NO: 14694 - protein, 8 aa, Artificial Sequence
  Synthetic Peptide encoding a CDR
IDPYYGGT

SEQ ID NO: 14695 - protein, 8 aa, Artificial Sequence
  Synthetic Peptide encoding a CDR
IDPYYGGT

SEQ ID NO: 14696 - protein, 8 aa, Artificial Sequence
  Synthetic Peptide encoding a CDR
ISGSGGRP

SEQ ID NO: 14697 - protein, 8 aa, Artificial Sequence
  Synthetic Peptide encoding a CDR
ISGSGGRT

SEQ ID NO: 14698 - protein, 8 aa, Artificial Sequence
  Synthetic Peptide encoding a CDR
ISGSGGRT

SEQ ID NO: 14699 - protein, 8 aa, Artificial Sequence
  Synthetic Peptide encoding a CDR
ISGSGGST

SEQ ID NO: 14700 - protein, 8 aa, Artificial Sequence
  Synthetic Peptide encoding a CDR
ISYDGRNK

SEQ ID NO: 14701 - protein, 6 aa, Artificial Sequence
  Synthetic Peptide encoding a CDR
YYSGST

SEQ ID NO: 14702 - protein, 7 aa, Artificial Sequence
  Synthetic Peptide encoding a CDR
ISYDGSI

SEQ ID NO: 14703 - protein, 8 aa, Artificial Sequence
  Synthetic Peptide encoding a CDR
ISGSGGST

SEQ ID NO: 14704 - protein, 8 aa, Artificial Sequence
  Synthetic Peptide encoding a CDR
ISGSGGRT

SEQ ID NO: 14705 - protein, 8 aa, Artificial Sequence
  Synthetic Peptide encoding a CDR
MNPSGGGT

SEQ ID NO: 14706 - protein, 8 aa, Artificial Sequence
  Synthetic Peptide encoding a CDR
MNPMGGQV

SEQ ID NO: 14707 - protein, 8 aa, Artificial Sequence
  Synthetic Peptide encoding a CDR
MNPVYGQV

SEQ ID NO: 14708 - protein, 8 aa, Artificial Sequence
  Synthetic Peptide encoding a CDR
MNPLHGGV

SEQ ID NO: 14709 - protein, 8 aa, Artificial Sequence
  Synthetic Peptide encoding a CDR
MNPLHGGV

SEQ ID NO: 14710 - protein, 8 aa, Artificial Sequence
  Synthetic Peptide encoding a CDR
MNPTYGQV

SEQ ID NO: 14711 - protein, 8 aa, Artificial Sequence
  Synthetic Peptide encoding a CDR
INPLRGGV

SEQ ID NO: 14712 - protein, 8 aa, Artificial Sequence
  Synthetic Peptide encoding a CDR
MNPMGGAV

SEQ ID NO: 14713 - protein, 7 aa, Artificial Sequence
  Synthetic Peptide encoding a CDR
IYHNGNT

SEQ ID NO: 14714 - protein, 7 aa, Artificial Sequence
  Synthetic Peptide encoding a CDR
IYYNGNT

SEQ ID NO: 14715 - protein, 8 aa, Artificial Sequence
  Synthetic Peptide encoding a CDR
IRPNNGGT

SEQ ID NO: 14716 - protein, 8 aa, Artificial Sequence
  Synthetic Peptide encoding a CDR
IMPLLGTA

SEQ ID NO: 14717 - protein, 8 aa, Artificial Sequence
  Synthetic Peptide encoding a CDR
IIPFFGSA

SEQ ID NO: 14718 - protein, 7 aa, Artificial Sequence
  Synthetic Peptide encoding a CDR
IPFFGSA

SEQ ID NO: 14719 - protein, 7 aa, Artificial Sequence
  Synthetic Peptide encoding a CDR
IPFFGAA

SEQ ID NO: 14720 - protein, 7 aa, Artificial Sequence
  Synthetic Peptide encoding a CDR
IPFFGAA

SEQ ID NO: 14721 - protein, 7 aa, Artificial Sequence
  Synthetic Peptide encoding a CDR
IPFFGTA

SEQ ID NO: 14722 - protein, 8 aa, Artificial Sequence
  Synthetic Peptide encoding a CDR
TYPADSDT

SEQ ID NO: 14723 - protein, 8 aa, Artificial Sequence
  Synthetic Peptide encoding a CDR
TYPDDSDT

SEQ ID NO: 14724 - protein, 7 aa, Artificial Sequence
  Synthetic Peptide encoding a CDR
IWSDGST

SEQ ID NO: 14725 - protein, 10 aa, Artificial Sequence
  Synthetic Peptide encoding a CDR
IRFKSHNYAT

SEQ ID NO: 14726 - protein, 8 aa, Artificial Sequence
  Synthetic Peptide encoding a CDR
INTESGVP

SEQ ID NO: 14727 - protein, 8 aa, Artificial Sequence
  Synthetic Peptide encoding a CDR
INTESGVP

SEQ ID NO: 14728 - protein, 8 aa, Artificial Sequence
  Synthetic Peptide encoding a CDR
INTESGVP

SEQ ID NO: 14729 - protein, 8 aa, Artificial Sequence
  Synthetic Peptide encoding a CDR
INTESGVP

SEQ ID NO: 14730 - protein, 8 aa, Artificial Sequence
  Synthetic Peptide encoding a CDR
INTESGVP

SEQ ID NO: 14731 - protein, 8 aa, Artificial Sequence
  Synthetic Peptide encoding a CDR
INTESGVP

SEQ ID NO: 14732 - protein, 8 aa, Artificial Sequence
  Synthetic Peptide encoding a CDR
INTESGVP

SEQ ID NO: 14733 - protein, 8 aa, Artificial Sequence
  Synthetic Peptide encoding a CDR
INPNNGDS

SEQ ID NO: 14734 - protein, 13 aa, Artificial Sequence
  Synthetic Peptide encoding a CDR
VRYYYGSSGYFDY

SEQ ID NO: 14735 - protein, 13 aa, Artificial Sequence
  Synthetic Peptide encoding a CDR
ARRRYYGSSSFDY

SEQ ID NO: 14736 - protein, 17 aa, Artificial Sequence
  Synthetic Peptide encoding a CDR
AREGGYYYGRSYYTMDY

SEQ ID NO: 14737 - protein, 11 aa, Artificial Sequence
  Synthetic Peptide encoding a CDR
ARSPYSGVLDK

SEQ ID NO: 14738 - protein, 10 aa, Artificial Sequence
  Synthetic Peptide encoding a CDR
ARMWTFSQDG

SEQ ID NO: 14739 - protein, 10 aa, Artificial Sequence
  Synthetic Peptide encoding a CDR
SNDYLYSLDF

SEQ ID NO: 14740 - protein, 14 aa, Artificial Sequence
  Synthetic Peptide encoding a CDR
ARGAIYDGYDVLDN

SEQ ID NO: 14741 - protein, 11 aa, Artificial Sequence
  Synthetic Peptide encoding a CDR
ARSTWYRPLDY

SEQ ID NO: 14742 - protein, 13 aa, Artificial Sequence
  Synthetic Peptide encoding a CDR
ARSHLLRASWFAY

SEQ ID NO: 14743 - protein, 15 aa, Artificial Sequence
  Synthetic Peptide encoding a CDR
ARRDYYGNFYYAMDY

SEQ ID NO: 14744 - protein, 11 aa, Artificial Sequence
  Synthetic Peptide encoding a CDR
ARDYGYGYFDY

SEQ ID NO: 14745 - protein, 14 aa, Artificial Sequence
  Synthetic Peptide encoding a CDR
ARGTYYYGSRVFDY

SEQ ID NO: 14746 - protein, 12 aa, Artificial Sequence
  Synthetic Peptide encoding a CDR
ARMELWSYYFDY

SEQ ID NO: 14747 - protein, 12 aa, Artificial Sequence
  Synthetic Peptide encoding a CDR
ARMELWSYYFDY

SEQ ID NO: 14748 - protein, 17 aa, Artificial Sequence
  Synthetic Peptide encoding a CDR
ARRETTTVGRYYYAMDY

SEQ ID NO: 14749 - protein, 14 aa, Artificial Sequence
  Synthetic Peptide encoding a CDR
AKHYYYGGSYAMDY

SEQ ID NO: 14750 - protein, 14 aa, Artificial Sequence
  Synthetic Peptide encoding a CDR
AKHYYYGGSYAMDY

SEQ ID NO: 14751 - protein, 14 aa, Artificial Sequence
  Synthetic Peptide encoding a CDR
AKHYYYGGSYAMDY

SEQ ID NO: 14752 - protein, 15 aa, Artificial Sequence
  Synthetic Peptide encoding a CDR
AKDIQYGNYYYGMDV

SEQ ID NO: 14753 - protein, 12 aa, Artificial Sequence
  Synthetic Peptide encoding a CDR
ARNVFDGYWLVY

SEQ ID NO: 14754 - protein, 13 aa, Artificial Sequence
  Synthetic Peptide encoding a CDR
ARDGSSWDWYFDV

SEQ ID NO: 14755 - protein, 11 aa, Artificial Sequence
  Synthetic Peptide encoding a CDR
VRAPGNRAMEY

SEQ ID NO: 14756 - protein, 14 aa, Artificial Sequence
  Synthetic Peptide encoding a CDR
AREVTGDLEDAFDI

SEQ ID NO: 14757 - protein, 10 aa, Artificial Sequence
  Synthetic Peptide encoding a CDR
ARWGGGAFDI

SEQ ID NO: 14758 - protein, 6 aa, Artificial Sequence
  Synthetic Peptide encoding a CDR
ASLTAY

SEQ ID NO: 14759 - protein, 10 aa, Artificial Sequence
  Synthetic Peptide encoding a CDR
ANYGNYWFAY

SEQ ID NO: 14760 - protein, 13 aa, Artificial Sequence
  Synthetic Peptide encoding a CDR
VRGYFDWVDYFDY

SEQ ID NO: 14761 - protein, 13 aa, Artificial Sequence
  Synthetic Peptide encoding a CDR
TREPLTGYYAMDY

SEQ ID NO: 14762 - protein, 9 aa, Artificial Sequence
  Synthetic Peptide encoding a CDR
TRGNWDVVY

SEQ ID NO: 14763 - protein, 11 aa, Artificial Sequence
  Synthetic Peptide encoding a CDR
AREVRLRYFDV

SEQ ID NO: 14764 - protein, 15 aa, Artificial Sequence
  Synthetic Peptide encoding a CDR
ARWSWSDGYYVYFDY

SEQ ID NO: 14765 - protein, 15 aa, Artificial Sequence
  Synthetic Peptide encoding a CDR
ARGYGNYARGAWLAY

SEQ ID NO: 14766 - protein, 7 aa, Artificial Sequence
  Synthetic Peptide encoding a CDR
ARQGLDY

SEQ ID NO: 14767 - protein, 14 aa, Artificial Sequence
  Synthetic Peptide encoding a CDR
ARRMITTGDWYFDV

SEQ ID NO: 14768 - protein, 14 aa, Artificial Sequence
  Synthetic Peptide encoding a CDR
ARRMITTGDWYFDV

SEQ ID NO: 14769 - protein, 11 aa, Artificial Sequence
  Synthetic Peptide encoding a CDR
ARDYGDYGMDY

SEQ ID NO: 14770 - protein, 6 aa, Artificial Sequence
  Synthetic Peptide encoding a CDR
ARNLYL

SEQ ID NO: 14771 - protein, 10 aa, Artificial Sequence
  Synthetic Peptide encoding a CDR
TRRVPIRLDY

SEQ ID NO: 14772 - protein, 16 aa, Artificial Sequence
  Synthetic Peptide encoding a CDR
ARWGYSYRNYAYYYDY

SEQ ID NO: 14773 - protein, 19 aa, Artificial Sequence
  Synthetic Peptide encoding a CDR
ARDQRRIAAAGTHFYGMDV

SEQ ID NO: 14774 - protein, 9 aa, Artificial Sequence
  Synthetic Peptide encoding a CDR
ARGGGYFDY

SEQ ID NO: 14775 - protein, 11 aa, Artificial Sequence
  Synthetic Peptide encoding a CDR
ARQWGSYAFDS

SEQ ID NO: 14776 - protein, 11 aa, Artificial Sequence
  Synthetic Peptide encoding a CDR
ARHDGYSYFDY

SEQ ID NO: 14777 - protein, 12 aa, Artificial Sequence
  Synthetic Peptide encoding a CDR
ARSGQFGNYFDY

SEQ ID NO: 14778 - protein, 13 aa, Artificial Sequence
  Synthetic Peptide encoding a CDR
TRDDGYYGYAMDY

SEQ ID NO: 14779 - protein, 13 aa, Artificial Sequence
  Synthetic Peptide encoding a CDR
ARPIYFDNDYFDY

SEQ ID NO: 14780 - protein, 7 aa, Artificial Sequence
  Synthetic Peptide encoding a CDR
ARRIGVA

SEQ ID NO: 14781 - protein, 15 aa, Artificial Sequence
  Synthetic Peptide encoding a CDR
TRWGYGSSLYYAMDY

SEQ ID NO: 14782 - protein, 12 aa, Artificial Sequence
  Synthetic Peptide encoding a CDR
ARPDGNYWYFDV

SEQ ID NO: 14783 - protein, 13 aa, Artificial Sequence
  Synthetic Peptide encoding a CDR
ARSTMIATRAMDY

SEQ ID NO: 14784 - protein, 13 aa, Artificial Sequence
  Synthetic Peptide encoding a CDR
AIVGSFSGIAYRP

SEQ ID NO: 14785 - protein, 13 aa, Artificial Sequence
  Synthetic Peptide encoding a CDR
AIVGSFSPLTLGL

SEQ ID NO: 14786 - protein, 16 aa, Artificial Sequence
  Synthetic Peptide encoding a CDR
ARIVSFDNDVVSAMDY

SEQ ID NO: 14787 - protein, 11 aa, Artificial Sequence
  Synthetic Peptide encoding a CDR
ARIGDSSPSDY

SEQ ID NO: 14788 - protein, 9 aa, Artificial Sequence
  Synthetic Peptide encoding a CDR
AKSDTAFDY

SEQ ID NO: 14789 - protein, 13 aa, Artificial Sequence
  Synthetic Peptide encoding a CDR
ARALTYYDYEFAY

SEQ ID NO: 14790 - protein, 16 aa, Artificial Sequence
  Synthetic Peptide encoding a CDR
TRQGLWFDSDGRGFDF

SEQ ID NO: 14791 - protein, 9 aa, Artificial Sequence
  Synthetic Peptide encoding a CDR
AGSSGWSEY

SEQ ID NO: 14792 - protein, 7 aa, Artificial Sequence
  Synthetic Peptide encoding a CDR
AFRGGVY

SEQ ID NO: 14793 - protein, 20 aa, Artificial Sequence
  Synthetic Peptide encoding a CDR
AKDMGWGSGWRPYYYYGMDV

SEQ ID NO: 14794 - protein, 12 aa, Artificial Sequence
  Synthetic Peptide encoding a CDR
ARLRNWDEPMDY

SEQ ID NO: 14795 - protein, 8 aa, Artificial Sequence
  Synthetic Peptide encoding a CDR
TGSYYGMD

SEQ ID NO: 14796 - protein, 15 aa, Artificial Sequence
  Synthetic Peptide encoding a CDR
ATFALFGFREQAFDI

SEQ ID NO: 14797 - protein, 15 aa, Artificial Sequence
  Synthetic Peptide encoding a CDR
ARDRSYGDSSWALDA

SEQ ID NO: 14798 - protein, 11 aa, Artificial Sequence
  Synthetic Peptide encoding a CDR
TRYDGSRAMDY

SEQ ID NO: 14799 - protein, 17 aa, Artificial Sequence
  Synthetic Peptide encoding a CDR
AREAYASYGSGSYWTDY

SEQ ID NO: 14800 - protein, 6 aa, Artificial Sequence
  Synthetic Peptide encoding a CDR
VSGMEY

SEQ ID NO: 14801 - protein, 13 aa, Artificial Sequence
  Synthetic Peptide encoding a CDR
ASRGGHYGYALDY

SEQ ID NO: 14802 - protein, 12 aa, Artificial Sequence
  Synthetic Peptide encoding a CDR
TRVKLGTYYFDS

SEQ ID NO: 14803 - protein, 18 aa, Artificial Sequence
  Synthetic Peptide encoding a CDR
ARVFYDINSGYYLDGMDL

SEQ ID NO: 14804 - protein, 13 aa, Artificial Sequence
  Synthetic Peptide encoding a CDR
VRYANIGYEYFNV

SEQ ID NO: 14805 - protein, 14 aa, Artificial Sequence
  Synthetic Peptide encoding a CDR
AGTVTTYYYFGMDV

SEQ ID NO: 14806 - protein, 15 aa, Artificial Sequence
  Synthetic Peptide encoding a CDR
AGTVTTYYYDFGMDV

SEQ ID NO: 14807 - protein, 17 aa, Artificial Sequence
  Synthetic Peptide encoding a CDR
AKTLSAGEWIGGGAFDI

SEQ ID NO: 14808 - protein, 12 aa, Artificial Sequence
  Synthetic Peptide encoding a CDR
ARGNWEGWYFDV

SEQ ID NO: 14809 - protein, 8 aa, Artificial Sequence
  Synthetic Peptide encoding a CDR
TSCYYYTY

SEQ ID NO: 14810 - protein, 11 aa, Artificial Sequence
  Synthetic Peptide encoding a CDR
ARGYNWNYFDY

SEQ ID NO: 14811 - protein, 11 aa, Artificial Sequence
  Synthetic Peptide encoding a CDR
ARYISRGLGDS

SEQ ID NO: 14812 - protein, 10 aa, Artificial Sequence
  Synthetic Peptide encoding a CDR
ARGYGKAYDQ

SEQ ID NO: 14813 - protein, 13 aa, Artificial Sequence
  Synthetic Peptide encoding a CDR
SRWGGDGFYAMDV

SEQ ID NO: 14814 - protein, 11 aa, Artificial Sequence
  Synthetic Peptide encoding a CDR
ARAWGVGPPDY

SEQ ID NO: 14815 - protein, 7 aa, Artificial Sequence
  Synthetic Peptide encoding a CDR
ARQRSDY

SEQ ID NO: 14816 - protein, 12 aa, Artificial Sequence
  Synthetic Peptide encoding a CDR
ARFGGEVLRYTD

SEQ ID NO: 14817 - protein, 8 aa, Artificial Sequence
  Synthetic Peptide encoding a CDR
DYNWDFEH

SEQ ID NO: 14818 - protein, 24 aa, Artificial Sequence
  Synthetic Peptide encoding a CDR
ARDFGPDWEDGDSYDGSGRGFFDF

SEQ ID NO: 14819 - protein, 13 aa, Artificial Sequence
  Synthetic Peptide encoding a CDR
TSYGNYVGHYFDH

SEQ ID NO: 14820 - protein, 15 aa, Artificial Sequence
  Synthetic Peptide encoding a CDR
AGDTDSSGYYGAVDY

SEQ ID NO: 14821 - protein, 17 aa, Artificial Sequence
  Synthetic Peptide encoding a CDR
ARDFDYGDSYYYYGMDV

SEQ ID NO: 14822 - protein, 11 aa, Artificial Sequence
  Synthetic Peptide encoding a CDR
AKGPGWGSFDL

SEQ ID NO: 14823 - protein, 10 aa, Artificial Sequence
  Synthetic Peptide encoding a CDR
ARDHRDAMDY

SEQ ID NO: 14824 - protein, 15 aa, Artificial Sequence
  Synthetic Peptide encoding a CDR
ARQGTTALATRFFDV

SEQ ID NO: 14825 - protein, 12 aa, Artificial Sequence
  Synthetic Peptide encoding a CDR
ARLLARATAMDV

SEQ ID NO: 14826 - protein, 18 aa, Artificial Sequence
  Synthetic Peptide encoding a CDR
ARSGHITVFGVNVDAFDM

SEQ ID NO: 14827 - protein, 10 aa, Artificial Sequence
  Synthetic Peptide encoding a CDR
TRPSLYAMDY

SEQ ID NO: 14828 - protein, 15 aa, Artificial Sequence
  Synthetic Peptide encoding a CDR
TRWGYGSSLYYAMDY

SEQ ID NO: 14829 - protein, 10 aa, Artificial Sequence
  Synthetic Peptide encoding a CDR
ALGGGYAMDY

SEQ ID NO: 14830 - protein, 10 aa, Artificial Sequence
  Synthetic Peptide encoding a CDR
RANWDVAFAY

SEQ ID NO: 14831 - protein, 12 aa, Artificial Sequence
  Synthetic Peptide encoding a CDR
ARYRSYDWYFDV

SEQ ID NO: 14832 - protein, 12 aa, Artificial Sequence
  Synthetic Peptide encoding a CDR
ARGTRDGSWFAY

SEQ ID NO: 14833 - protein, 12 aa, Artificial Sequence
  Synthetic Peptide encoding a CDR
ASHYGSTLAFAS

SEQ ID NO: 14834 - protein, 16 aa, Artificial Sequence
  Synthetic Peptide encoding a CDR
TRRIGNSDYDWWYFDV

SEQ ID NO: 14835 - protein, 13 aa, Artificial Sequence
  Synthetic Peptide encoding a CDR
ARDVGSGSYSLDY

SEQ ID NO: 14836 - protein, 10 aa, Artificial Sequence
  Synthetic Peptide encoding a CDR
ARHVGHELDY

SEQ ID NO: 14837 - protein, 11 aa, Artificial Sequence
  Synthetic Peptide encoding a CDR
AREGKNGAFDI

SEQ ID NO: 14838 - protein, 11 aa, Artificial Sequence
  Synthetic Peptide encoding a CDR
AREGKNGAFDI

SEQ ID NO: 14839 - protein, 11 aa, Artificial Sequence
  Synthetic Peptide encoding a CDR
ARLGRRYALDY

SEQ ID NO: 14840 - protein, 11 aa, Artificial Sequence
  Synthetic Peptide encoding a CDR
ARLGRRYTMDY

SEQ ID NO: 14841 - protein, 11 aa, Artificial Sequence
  Synthetic Peptide encoding a CDR
ARLGRRYTMDY

SEQ ID NO: 14842 - protein, 11 aa, Artificial Sequence
  Synthetic Peptide encoding a CDR
VRQGGDFPMDY

SEQ ID NO: 14843 - protein, 8 aa, Artificial Sequence
  Synthetic Peptide encoding a CDR
ASYYEGGY

SEQ ID NO: 14844 - protein, 11 aa, Artificial Sequence
  Synthetic Peptide encoding a CDR
ARGYDDYSFAY

SEQ ID NO: 14845 - protein, 8 aa, Artificial Sequence
  Synthetic Peptide encoding a CDR
ARGRYFDV

SEQ ID NO: 14846 - protein, 8 aa, Artificial Sequence
  Synthetic Peptide encoding a CDR
ARRWFLDC

SEQ ID NO: 14847 - protein, 16 aa, Artificial Sequence
  Synthetic Peptide encoding a CDR
ARGPEYCINGVCSLDV

SEQ ID NO: 14848 - protein, 14 aa, Artificial Sequence
  Synthetic Peptide encoding a CDR
AVHYGDYVFSSMDV

SEQ ID NO: 14849 - protein, 16 aa, Artificial Sequence
  Synthetic Peptide encoding a CDR
ARQGFGNYGDYYAMDY

SEQ ID NO: 14850 - protein, 9 aa, Artificial Sequence
  Synthetic Peptide encoding a CDR
ANWDDAFNI

SEQ ID NO: 14851 - protein, 8 aa, Artificial Sequence
  Synthetic Peptide encoding a CDR
ATPGGFVY

SEQ ID NO: 14852 - protein, 12 aa, Artificial Sequence
  Synthetic Peptide encoding a CDR
AGELLPYYGMDV

SEQ ID NO: 14853 - protein, 12 aa, Artificial Sequence
  Synthetic Peptide encoding a CDR
AGMLLPYYGMDV

SEQ ID NO: 14854 - protein, 6 aa, Artificial Sequence
  Synthetic Peptide encoding a CDR
ASNVDH

SEQ ID NO: 14855 - protein, 6 aa, Artificial Sequence
  Synthetic Peptide encoding a CDR
ATNDDY

SEQ ID NO: 14856 - protein, 11 aa, Artificial Sequence
  Synthetic Peptide encoding a CDR
ARRHWPGGFDY

SEQ ID NO: 14857 - protein, 11 aa, Artificial Sequence
  Synthetic Peptide encoding a CDR
GRIAFKTGTSI

SEQ ID NO: 14858 - protein, 8 aa, Artificial Sequence
  Synthetic Peptide encoding a CDR
ARHEGGYY

SEQ ID NO: 14859 - protein, 17 aa, Artificial Sequence
  Synthetic Peptide encoding a CDR
ARDGITMIRGYYYGMDV

SEQ ID NO: 14860 - protein, 11 aa, Artificial Sequence
  Synthetic Peptide encoding a CDR
ARGGSYNYFDY

SEQ ID NO: 14861 - protein, 16 aa, Artificial Sequence
  Synthetic Peptide encoding a CDR
ARGGDFLYYYYYGMDV

SEQ ID NO: 14862 - protein, 8 aa, Artificial Sequence
  Synthetic Peptide encoding a CDR
AAGWNFDY

SEQ ID NO: 14863 - protein, 12 aa, Artificial Sequence
  Synthetic Peptide encoding a CDR
VRSNYGYAWFAY

SEQ ID NO: 14864 - protein, 8 aa, Artificial Sequence
  Synthetic Peptide encoding a CDR
ARNDLFAY

SEQ ID NO: 14865 - protein, 13 aa, Artificial Sequence
  Synthetic Peptide encoding a CDR
GRYDYDGYYAMDY

SEQ ID NO: 14866 - protein, 13 aa, Artificial Sequence
  Synthetic Peptide encoding a CDR
ARWKIYYGNYEDY

SEQ ID NO: 14867 - protein, 16 aa, Artificial Sequence
  Synthetic Peptide encoding a CDR
AKDIRRFSTGGAEFEY

SEQ ID NO: 14868 - protein, 19 aa, Artificial Sequence
  Synthetic Peptide encoding a CDR
AKRPNQFYCSDGRCYSIDY

SEQ ID NO: 14869 - protein, 13 aa, Artificial Sequence
  Synthetic Peptide encoding a CDR
ARVDGYRGYNMDY

SEQ ID NO: 14870 - protein, 13 aa, Artificial Sequence
  Synthetic Peptide encoding a CDR
ARAHNSSSWSFDY

SEQ ID NO: 14871 - protein, 17 aa, Artificial Sequence
  Synthetic Peptide encoding a CDR
ARGAGYNFDGAYRFFDF

SEQ ID NO: 14872 - protein, 12 aa, Artificial Sequence
  Synthetic Peptide encoding a CDR
ASPRGRGSAFDI

SEQ ID NO: 14873 - protein, 11 aa, Artificial Sequence
  Synthetic Peptide encoding a CDR
ARTRSSGAFDI

SEQ ID NO: 14874 - protein, 11 aa, Artificial Sequence
  Synthetic Peptide encoding a CDR
GRSGNDDAMDY

SEQ ID NO: 14875 - protein, 16 aa, Artificial Sequence
  Synthetic Peptide encoding a CDR
ARELRFLEWSSDAFDI

SEQ ID NO: 14876 - protein, 12 aa, Artificial Sequence
  Synthetic Peptide encoding a CDR
ARDGERAWDLDY

SEQ ID NO: 14877 - protein, 13 aa, Artificial Sequence
  Synthetic Peptide encoding a CDR
PRGPTMIRGVIDS

SEQ ID NO: 14878 - protein, 16 aa, Artificial Sequence
  Synthetic Peptide encoding a CDR
ARDYYDNSRHHWGFDY

SEQ ID NO: 14879 - protein, 13 aa, Artificial Sequence
  Synthetic Peptide encoding a CDR
ARDHDRDYYAMDY

SEQ ID NO: 14880 - protein, 9 aa, Artificial Sequence
  Synthetic Peptide encoding a CDR
KRSYGNYDY

SEQ ID NO: 14881 - protein, 9 aa, Artificial Sequence
  Synthetic Peptide encoding a CDR
KTSTFFFDY

SEQ ID NO: 14882 - protein, 14 aa, Artificial Sequence
  Synthetic Peptide encoding a CDR
GRGGYGSSYWYFDV

SEQ ID NO: 14883 - protein, 13 aa, Artificial Sequence
  Synthetic Peptide encoding a CDR
ARDGDYDRYTMDY

SEQ ID NO: 14884 - protein, 20 aa, Artificial Sequence
  Synthetic Peptide encoding a CDR
ARGGRYCSSISCYARSGCDY

SEQ ID NO: 14885 - protein, 12 aa, Artificial Sequence
  Synthetic Peptide encoding a CDR
VGLDWNYNPLRY

SEQ ID NO: 14886 - protein, 10 aa, Artificial Sequence
  Synthetic Peptide encoding a CDR
ARRDWDYFDY

SEQ ID NO: 14887 - protein, 14 aa, Artificial Sequence
  Synthetic Peptide encoding a CDR
ARSLYGGYKDAFDS

SEQ ID NO: 14888 - protein, 14 aa, Artificial Sequence
  Synthetic Peptide encoding a CDR
ARGGGYYETSGPDY

SEQ ID NO: 14889 - protein, 12 aa, Artificial Sequence
  Synthetic Peptide encoding a CDR
VGSPYGDYVLDY

SEQ ID NO: 14890 - protein, 16 aa, Artificial Sequence
  Synthetic Peptide encoding a CDR
AKDRYGWGSSFGHFDY

SEQ ID NO: 14891 - protein, 13 aa, Artificial Sequence
  Synthetic Peptide encoding a CDR
ARGDSSSWYAFDY

SEQ ID NO: 14892 - protein, 14 aa, Artificial Sequence
  Synthetic Peptide encoding a CDR
ARVQYSGYYDWFDP

SEQ ID NO: 14893 - protein, 11 aa, Artificial Sequence
  Synthetic Peptide encoding a CDR
VRHTALAGFDY

SEQ ID NO: 14894 - protein, 12 aa, Artificial Sequence
  Synthetic Peptide encoding a CDR
ARRIPPYYGMDV

SEQ ID NO: 14895 - protein, 14 aa, Artificial Sequence
  Synthetic Peptide encoding a CDR
ARERGYGYHDPHDY

SEQ ID NO: 14896 - protein, 14 aa, Artificial Sequence
  Synthetic Peptide encoding a CDR
ARERGYGYHDPHDY

SEQ ID NO: 14897 - protein, 13 aa, Artificial Sequence
  Synthetic Peptide encoding a CDR
ARWGNYPHYAMDY

SEQ ID NO: 14898 - protein, 11 aa, Artificial Sequence
  Synthetic Peptide encoding a CDR
ARSGGYDPMDY

SEQ ID NO: 14899 - protein, 12 aa, Artificial Sequence
  Synthetic Peptide encoding a CDR
ARERYFDWSFDY

SEQ ID NO: 14900 - protein, 11 aa, Artificial Sequence
  Synthetic Peptide encoding a CDR
ARDISYGSFDY

SEQ ID NO: 14901 - protein, 14 aa, Artificial Sequence
  Synthetic Peptide encoding a CDR
ARERGLYQLRAMDY

SEQ ID NO: 14902 - protein, 6 aa, Artificial Sequence
  Synthetic Peptide encoding a CDR
ARSLRY

SEQ ID NO: 14903 - protein, 9 aa, Artificial Sequence
  Synthetic Peptide encoding a CDR
AREITTVDY

SEQ ID NO: 14904 - protein, 14 aa, Artificial Sequence
  Synthetic Peptide encoding a CDR
ARLDGSSYRGAMDS

SEQ ID NO: 14905 - protein, 14 aa, Artificial Sequence
  Synthetic Peptide encoding a CDR
ARGSHYFGHWHFAV

SEQ ID NO: 14906 - protein, 9 aa, Artificial Sequence
  Synthetic Peptide encoding a CDR
ASLTTGSDS

SEQ ID NO: 14907 - protein, 13 aa, Artificial Sequence
  Synthetic Peptide encoding a CDR
ARERGYTYGNFDH

SEQ ID NO: 14908 - protein, 13 aa, Artificial Sequence
  Synthetic Peptide encoding a CDR
AKDRDFWSGPFDY

SEQ ID NO: 14909 - protein, 17 aa, Artificial Sequence
  Synthetic Peptide encoding a CDR
ARYNEYKSYIYDWYFDF

SEQ ID NO: 14910 - protein, 10 aa, Artificial Sequence
  Synthetic Peptide encoding a CDR
ARYYVSLVDI

SEQ ID NO: 14911 - protein, 15 aa, Artificial Sequence
  Synthetic Peptide encoding a CDR
ARDGLYSSSWYDSDY

SEQ ID NO: 14912 - protein, 19 aa, Artificial Sequence
  Synthetic Peptide encoding a CDR
AKDIHSGSYYGLLYYAMDV

SEQ ID NO: 14913 - protein, 14 aa, Artificial Sequence
  Synthetic Peptide encoding a CDR
ARGGYYSHDMWSED

SEQ ID NO: 14914 - protein, 10 aa, Artificial Sequence
  Synthetic Peptide encoding a CDR
ALDYSYAMDY

SEQ ID NO: 14915 - protein, 10 aa, Artificial Sequence
  Synthetic Peptide encoding a CDR
SNDYLYSLDY

SEQ ID NO: 14916 - protein, 13 aa, Artificial Sequence
  Synthetic Peptide encoding a CDR
ARSHLLRASWFAY

SEQ ID NO: 14917 - protein, 13 aa, Artificial Sequence
  Synthetic Peptide encoding a CDR
ARSHLLRASWFAY

SEQ ID NO: 14918 - protein, 11 aa, Artificial Sequence
  Synthetic Peptide encoding a CDR
ARGDGSTDLDY

SEQ ID NO: 14919 - protein, 12 aa, Artificial Sequence
  Synthetic Peptide encoding a CDR
AKTGSYFYAFDH

SEQ ID NO: 14920 - protein, 12 aa, Artificial Sequence
  Synthetic Peptide encoding a CDR
ALNYGSYYAMDA

SEQ ID NO: 14921 - protein, 12 aa, Artificial Sequence
  Synthetic Peptide encoding a CDR
AKDGVIEDTFDY

SEQ ID NO: 14922 - protein, 8 aa, Artificial Sequence
  Synthetic Peptide encoding a CDR
ARGNWDDY

SEQ ID NO: 14923 - protein, 12 aa, Artificial Sequence
  Synthetic Peptide encoding a CDR
ALNYGSYYAMDA

SEQ ID NO: 14924 - protein, 12 aa, Artificial Sequence
  Synthetic Peptide encoding a CDR
ATHSRGTDYFDY

SEQ ID NO: 14925 - protein, 11 aa, Artificial Sequence
  Synthetic Peptide encoding a CDR
ARGYYSSYLYL

SEQ ID NO: 14926 - protein, 18 aa, Artificial Sequence
  Synthetic Peptide encoding a CDR
ARWGDVYYGLMRGHVMDA

SEQ ID NO: 14927 - protein, 14 aa, Artificial Sequence
  Synthetic Peptide encoding a CDR
ARSGFITTVLDFDY

SEQ ID NO: 14928 - protein, 14 aa, Artificial Sequence
  Synthetic Peptide encoding a CDR
ARHVTMIWGVIIDF

SEQ ID NO: 14929 - protein, 14 aa, Artificial Sequence
  Synthetic Peptide encoding a CDR
ARGTYYYGTRVFDY

SEQ ID NO: 14930 - protein, 17 aa, Artificial Sequence
  Synthetic Peptide encoding a CDR
ARRETTTVGRYYYAMDY

SEQ ID NO: 14931 - protein, 14 aa, Artificial Sequence
  Synthetic Peptide encoding a CDR
ARSEYWGNYWAMDY

SEQ ID NO: 14932 - protein, 15 aa, Artificial Sequence
  Synthetic Peptide encoding a CDR
ARKTISSVVDFYFDN

SEQ ID NO: 14933 - protein, 13 aa, Artificial Sequence
  Synthetic Peptide encoding a CDR
ARGSNPYYYAMDY

SEQ ID NO: 14934 - protein, 14 aa, Artificial Sequence
  Synthetic Peptide encoding a CDR
ARSITTVVGCAMDY

SEQ ID NO: 14935 - protein, 17 aa, Artificial Sequence
  Synthetic Peptide encoding a CDR
ARRETTTVGRYYYAMDY

SEQ ID NO: 14936 - protein, 15 aa, Artificial Sequence
  Synthetic Peptide encoding a CDR
ARSNYYGSSYWFFDV

SEQ ID NO: 14937 - protein, 19 aa, Artificial Sequence
  Synthetic Peptide encoding a CDR
ARDYYGAGSFYDGLYGMDV

SEQ ID NO: 14938 - protein, 16 aa, Artificial Sequence
  Synthetic Peptide encoding a CDR
TKDNQYGSGSTYGLGV

SEQ ID NO: 14939 - protein, 15 aa, Artificial Sequence
  Synthetic Peptide encoding a CDR
ARVVYYSNSYWYFDV

SEQ ID NO: 14940 - protein, 14 aa, Artificial Sequence
  Synthetic Peptide encoding a CDR
ARSTYYGGDWYFDV

SEQ ID NO: 14941 - protein, 17 aa, Artificial Sequence
  Synthetic Peptide encoding a CDR
TRRTNYYGTSYYYAMDY

SEQ ID NO: 14942 - protein, 11 aa, Artificial Sequence
  Synthetic Peptide encoding a CDR
ARYDYNYAMDY

SEQ ID NO: 14943 - protein, 15 aa, Artificial Sequence
  Synthetic Peptide encoding a CDR
ARSHYGSNYVDYFDY

SEQ ID NO: 14944 - protein, 15 aa, Artificial Sequence
  Synthetic Peptide encoding a CDR
AKDIQYGNYYYGMDV

SEQ ID NO: 14945 - protein, 14 aa, Artificial Sequence
  Synthetic Peptide encoding a CDR
ARSTYVGGDWQFDV

SEQ ID NO: 14946 - protein, 10 aa, Artificial Sequence
  Synthetic Peptide encoding a CDR
ARNWADAFDI

SEQ ID NO: 14947 - protein, 12 aa, Artificial Sequence
  Synthetic Peptide encoding a CDR
AREMITAYYFDY

SEQ ID NO: 14948 - protein, 10 aa, Artificial Sequence
  Synthetic Peptide encoding a CDR
ASGYEDAMDY

SEQ ID NO: 14949 - protein, 10 aa, Artificial Sequence
  Synthetic Peptide encoding a CDR
AREWADVFDI

SEQ ID NO: 14950 - protein, 10 aa, Artificial Sequence
  Synthetic Peptide encoding a CDR
ARGYYYAFDF

SEQ ID NO: 14951 - protein, 10 aa, Artificial Sequence
  Synthetic Peptide encoding a CDR
ARGYYYAFDF

SEQ ID NO: 14952 - protein, 12 aa, Artificial Sequence
  Synthetic Peptide encoding a CDR
VRDGYYVSDMVV

SEQ ID NO: 14953 - protein, 7 aa, Artificial Sequence
  Synthetic Peptide encoding a CDR
ARRGGVD

SEQ ID NO: 14954 - protein, 13 aa, Artificial Sequence
  Synthetic Peptide encoding a CDR
ARDHYRYDPLLDY

SEQ ID NO: 14955 - protein, 15 aa, Artificial Sequence
  Synthetic Peptide encoding a CDR
AIERGADLEGYAMDY

SEQ ID NO: 14956 - protein, 16 aa, Artificial Sequence
  Synthetic Peptide encoding a CDR
AREGDYDVGNYYAMDY

SEQ ID NO: 14957 - protein, 16 aa, Artificial Sequence
  Synthetic Peptide encoding a CDR
AKEGDYDVGNYYAMDY

SEQ ID NO: 14958 - protein, 13 aa, Artificial Sequence
  Synthetic Peptide encoding a CDR
ARSTMIATGAMDY

SEQ ID NO: 14959 - protein, 10 aa, Artificial Sequence
  Synthetic Peptide encoding a CDR
ARDRGFYFDY

SEQ ID NO: 14960 - protein, 10 aa, Artificial Sequence
  Synthetic Peptide encoding a CDR
ARDRGYYFDY

SEQ ID NO: 14961 - protein, 10 aa, Artificial Sequence
  Synthetic Peptide encoding a CDR
ARDRGYYFDY

SEQ ID NO: 14962 - protein, 14 aa, Artificial Sequence
  Synthetic Peptide encoding a CDR
ARGKVYYGSNPFAY

SEQ ID NO: 14963 - protein, 13 aa, Artificial Sequence
  Synthetic Peptide encoding a CDR
ARSTMIATGAMDY

SEQ ID NO: 14964 - protein, 10 aa, Artificial Sequence
  Synthetic Peptide encoding a CDR
TGASYGMEYL

SEQ ID NO: 14965 - protein, 20 aa, Artificial Sequence
  Synthetic Peptide encoding a CDR
ARRSYDSSGYWGHFYSYMDV

SEQ ID NO: 14966 - protein, 7 aa, Artificial Sequence
  Synthetic Peptide encoding a CDR
ARVSFDY

SEQ ID NO: 14967 - protein, 11 aa, Artificial Sequence
  Synthetic Peptide encoding a CDR
ARYYHAGAFDL

SEQ ID NO: 14968 - protein, 16 aa, Artificial Sequence
  Synthetic Peptide encoding a CDR
AKNGESGPLDYWYLDL

SEQ ID NO: 14969 - protein, 12 aa, Artificial Sequence
  Synthetic Peptide encoding a CDR
ARAPQSWYVGDV

SEQ ID NO: 14970 - protein, 15 aa, Artificial Sequence
  Synthetic Peptide encoding a CDR
ARGVYGYSGSAPYDE

SEQ ID NO: 14971 - protein, 11 aa, Artificial Sequence
  Synthetic Peptide encoding a CDR
AGGDDLDAFDI

SEQ ID NO: 14972 - protein, 9 aa, Artificial Sequence
  Synthetic Peptide encoding a CDR
KTSTFFFDY

SEQ ID NO: 14973 - protein, 7 aa, Artificial Sequence
  Synthetic Peptide encoding a CDR
SVGYFDV

SEQ ID NO: 14974 - protein, 19 aa, Artificial Sequence
  Synthetic Peptide encoding a CDR
ARDDYYGSGSFNSYYGTDV

SEQ ID NO: 14975 - protein, 6 aa, Artificial Sequence
  Synthetic Peptide encoding a CDR
ARGLGY

SEQ ID NO: 14976 - protein, 23 aa, Artificial Sequence
  Synthetic Peptide encoding a CDR
ARQVWGWQGGMYPRSNWWYNLDS

SEQ ID NO: 14977 - protein, 10 aa, Artificial Sequence
  Synthetic Peptide encoding a CDR
ARPLDWTEDI

SEQ ID NO: 14978 - protein, 12 aa, Artificial Sequence
  Synthetic Peptide encoding a CDR
ARGDISQDFADV

SEQ ID NO: 14979 - protein, 10 aa, Artificial Sequence
  Synthetic Peptide encoding a CDR
ARYDYPWFAY

SEQ ID NO: 14980 - protein, 11 aa, Artificial Sequence
  Synthetic Peptide encoding a CDR
TRSWRGNSFDY

SEQ ID NO: 14981 - protein, 15 aa, Artificial Sequence
  Synthetic Peptide encoding a CDR
AREGYYGGRGYALDY

SEQ ID NO: 14982 - protein, 14 aa, Artificial Sequence
  Synthetic Peptide encoding a CDR
AREEYGNYVRYFDV

SEQ ID NO: 14983 - protein, 10 aa, Artificial Sequence
  Synthetic Peptide encoding a CDR
ALDWSYSIDY

SEQ ID NO: 14984 - protein, 13 aa, Artificial Sequence
  Synthetic Peptide encoding a CDR
ARPFYYSNSPFAY

SEQ ID NO: 14985 - protein, 13 aa, Artificial Sequence
  Synthetic Peptide encoding a CDR
ARTGRYEENAMDY

SEQ ID NO: 14986 - protein, 10 aa, Artificial Sequence
  Synthetic Peptide encoding a CDR
SNDYLYSLDY

SEQ ID NO: 14987 - protein, 10 aa, Artificial Sequence
  Synthetic Peptide encoding a CDR
SNDYLYSLDF

SEQ ID NO: 14988 - protein, 11 aa, Artificial Sequence
  Synthetic Peptide encoding a CDR
ARLGRRYTMDY

SEQ ID NO: 14989 - protein, 12 aa, Artificial Sequence
  Synthetic Peptide encoding a CDR
ARYYRYEAWFAS

SEQ ID NO: 14990 - protein, 17 aa, Artificial Sequence
  Synthetic Peptide encoding a CDR
AKDKGGGYYDFWSGSDY

SEQ ID NO: 14991 - protein, 17 aa, Artificial Sequence
  Synthetic Peptide encoding a CDR
ARDRLQDGNSWSDAFDV

SEQ ID NO: 14992 - protein, 15 aa, Artificial Sequence
  Synthetic Peptide encoding a CDR
ARGDSNYWSYYGMDV

SEQ ID NO: 14993 - protein, 17 aa, Artificial Sequence
  Synthetic Peptide encoding a CDR
ARDPYDFWSGYPDAFDI

SEQ ID NO: 14994 - protein, 17 aa, Artificial Sequence
  Synthetic Peptide encoding a CDR
ARVRLQDGNSWSDAFDV

SEQ ID NO: 14995 - protein, 14 aa, Artificial Sequence
  Synthetic Peptide encoding a CDR
ARHYYYGGSYAMDY

SEQ ID NO: 14996 - protein, 11 aa, Artificial Sequence
  Synthetic Peptide encoding a CDR
ARQGGDFPMDY

SEQ ID NO: 14997 - protein, 11 aa, Artificial Sequence
  Synthetic Peptide encoding a CDR
ARLGRRYALDY

SEQ ID NO: 14998 - protein, 15 aa, Artificial Sequence
  Synthetic Peptide encoding a CDR
ARVVDFDQDYNGFDY

SEQ ID NO: 14999 - protein, 13 aa, Artificial Sequence
  Synthetic Peptide encoding a CDR
ARGQWWSGGDFDY

SEQ ID NO: 15000 - protein, 9 aa, Artificial Sequence
  Synthetic Peptide encoding a CDR
ARSVGPFDS

SEQ ID NO: 15001 - protein, 9 aa, Artificial Sequence
  Synthetic Peptide encoding a CDR
ARSVGPMDY

SEQ ID NO: 15002 - protein, 13 aa, Artificial Sequence
  Synthetic Peptide encoding a CDR
AKVDYSNYLFFDY

SEQ ID NO: 15003 - protein, 13 aa, Artificial Sequence
  Synthetic Peptide encoding a CDR
AKHDYSNYPYFDY

SEQ ID NO: 15004 - protein, 13 aa, Artificial Sequence
  Synthetic Peptide encoding a CDR
AKHDYSNYPYFDY

SEQ ID NO: 15005 - protein, 13 aa, Artificial Sequence
  Synthetic Peptide encoding a CDR
ARHDYSNYPYFDY

SEQ ID NO: 15006 - protein, 11 aa, Artificial Sequence
  Synthetic Peptide encoding a CDR
AKDTDGYDFDY

SEQ ID NO: 15007 - protein, 14 aa, Artificial Sequence
  Synthetic Peptide encoding a CDR
ARGDGDYGGNCFDY

SEQ ID NO: 15008 - protein, 12 aa, Artificial Sequence
  Synthetic Peptide encoding a CDR
AREGPYSNYLDY

SEQ ID NO: 15009 - protein, 13 aa, Artificial Sequence
  Synthetic Peptide encoding a CDR
AKHDYSNYPYFDY

SEQ ID NO: 15010 - protein, 13 aa, Artificial Sequence
  Synthetic Peptide encoding a CDR
AKHDYSNYPYFDY

SEQ ID NO: 15011 - protein, 22 aa, Artificial Sequence
  Synthetic Peptide encoding a CDR
VRDRANGSGRRRFESVNWFLDL

SEQ ID NO: 15012 - protein, 21 aa, Artificial Sequence
  Synthetic Peptide encoding a CDR
VRDRSNGSGKRFESSNWFLDL

SEQ ID NO: 15013 - protein, 21 aa, Artificial Sequence
  Synthetic Peptide encoding a CDR
VRDTGDGSRRHFDSINWFLDL

SEQ ID NO: 15014 - protein, 13 aa, Artificial Sequence
  Synthetic Peptide encoding a CDR
TRGRDGYDDGFHP

SEQ ID NO: 15015 - protein, 13 aa, Artificial Sequence
  Synthetic Peptide encoding a CDR
TRGRDGYDDGFHP

SEQ ID NO: 15016 - protein, 13 aa, Artificial Sequence
  Synthetic Peptide encoding a CDR
ARGPSGENYPFHY

SEQ ID NO: 15017 - protein, 13 aa, Artificial Sequence
  Synthetic Peptide encoding a CDR
VRAPDSYDRGYDA

SEQ ID NO: 15018 - protein, 13 aa, Artificial Sequence
  Synthetic Peptide encoding a CDR
VRDPDAYERGFDA

SEQ ID NO: 15019 - protein, 22 aa, Artificial Sequence
  Synthetic Peptide encoding a CDR
ARNSARAGSHLLLGRDKSWFDP

SEQ ID NO: 15020 - protein, 22 aa, Artificial Sequence
  Synthetic Peptide encoding a CDR
ARNSARAGSHLLLGRDKSWFDP

SEQ ID NO: 15021 - protein, 12 aa, Artificial Sequence
  Synthetic Peptide encoding a CDR
VPHRWPDYFDSW

SEQ ID NO: 15022 - protein, 26 aa, Artificial Sequence
  Synthetic Peptide encoding a CDR
ATSSEADDYSTGFEMGEYYYDYYVDV

SEQ ID NO: 15023 - protein, 24 aa, Artificial Sequence
  Synthetic Peptide encoding a CDR
AGRGETNDYGDGGEFGYYYSYLDD

SEQ ID NO: 15024 - protein, 24 aa, Artificial Sequence
  Synthetic Peptide encoding a CDR
AGRGETNDYADGGEFGYYYSYMAD

SEQ ID NO: 15025 - protein, 24 aa, Artificial Sequence
  Synthetic Peptide encoding a CDR
AGRGETNDYGDDGRFGYYYSYMAD

SEQ ID NO: 15026 - protein, 24 aa, Artificial Sequence
  Synthetic Peptide encoding a CDR
AGRGDTNDYGDDGQFGYYYSYMGD

SEQ ID NO: 15027 - protein, 24 aa, Artificial Sequence
  Synthetic Peptide encoding a CDR
AGSESPNEYGDSTQFGFYYNYMAV

SEQ ID NO: 15028 - protein, 16 aa, Artificial Sequence
  Synthetic Peptide encoding a CDR
ARLGGQCTDGVCYFDH

SEQ ID NO: 15029 - protein, 16 aa, Artificial Sequence
  Synthetic Peptide encoding a CDR
ARLGGQCSDGVCYFDH

SEQ ID NO: 15030 - protein, 12 aa, Artificial Sequence
  Synthetic Peptide encoding a CDR
ARHYGSTLAFAS

SEQ ID NO: 15031 - protein, 16 aa, Artificial Sequence
  Synthetic Peptide encoding a CDR
VRRIGNSDYDWWYFDV

SEQ ID NO: 15032 - protein, 9 aa, Artificial Sequence
  Synthetic Peptide encoding a CDR
VRRIGNSDY

SEQ ID NO: 15033 - protein, 9 aa, Artificial Sequence
  Synthetic Peptide encoding a CDR
VRRIGNSDY

SEQ ID NO: 15034 - protein, 9 aa, Artificial Sequence
  Synthetic Peptide encoding a CDR
VRRIGNSDY

SEQ ID NO: 15035 - protein, 9 aa, Artificial Sequence
  Synthetic Peptide encoding a CDR
VRRIGNSDY

SEQ ID NO: 15036 - protein, 9 aa, Artificial Sequence
  Synthetic Peptide encoding a CDR
VRRIGNSDY

SEQ ID NO: 15037 - protein, 9 aa, Artificial Sequence
  Synthetic Peptide encoding a CDR
VRRIGNSDY

SEQ ID NO: 15038 - protein, 9 aa, Artificial Sequence
  Synthetic Peptide encoding a CDR
VRRIGNSDY

SEQ ID NO: 15039 - protein, 15 aa, Artificial Sequence
  Synthetic Peptide encoding a CDR
AREGYYGGRGYALDY

SEQ ID NO: 15040 - protein, 141 aa, Homo sapiens
DIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 15041 - protein, 140 aa, Homo sapiens
IQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 15042 - protein, 140 aa, Artificial Sequence
  Synthetic Polypeptide encoding a TCR chain
IQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 15043 - protein, 140 aa, Artificial Sequence; identical to SEQ ID NO: 15041
  Synthetic Polypeptide encoding a TCR chain

SEQ ID NO: 15044 - protein, 137 aa, Artificial Sequence
  Synthetic Polypeptide encoding a TCR chain
PDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 15045 - protein, 140 aa, Artificial Sequence
  Synthetic Polypeptide encoding a TCR chain
IQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 15046 - protein, 137 aa, Artificial Sequence
  Synthetic Polypeptide encoding a TCR chain
PDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 15047 - protein, 140 aa, Artificial Sequence
  Synthetic Polypeptide encoding a TCR chain
IQNPDPAVYQLRDSKSSDKSVCLFTDFDSQTNVSQSKDSDVYITDKTVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 15048 - protein, 140 aa, Artificial Sequence
  Synthetic Polypeptide encoding a TCR chain
IQNPDPAVYQLRDSKSSDKSVCLFTDFDSQTNVSQSKDSDVYITDKTVLDMRSMDFKSNRAVAWSNKSDFACANAFNNSIIPEDTFFPSPESSCDVKLVEKSFETDTNLNFQNLSVIGFRILLLKVAGFNLLMTLRLWSS

SEQ ID NO: 15049 - protein, 140 aa, Artificial Sequence
  Synthetic Polypeptide encoding a TCR chain
IQNPDPAVYQLRDSKSSDKSVCLFTDFDSQTNVSQSKDSDVYITDKTVLDMRSMDFKSNRAVAWSNKSDFACANAFNNSIIPEDTFFPSSDVPCDVKLVEKSFETDTNLNFQNLSVIGFRILLLKVAGFNLLMTLRLWSS

SEQ ID NO: 15050 - protein, 140 aa, Artificial Sequence
  Synthetic Polypeptide encoding a TCR chain
IQNPDPAVYQLRDSKSSDKSVCLFTDFDSQTNVSQSKDSDVYITDKTVLDMRSMDFKSNSAVAWSNKSDFACANAFNNSIIPEDTFFPSSDSSCDVKLVEKSFETDTNLNFQNLSVIGFRILLLKVAGFNLLMTLRLWSS

SEQ ID NO: 15051 - protein, 177 aa, Homo sapiens
EDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 15052 - protein, 179 aa, Homo sapiens
EDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 15053 - protein, 179 aa, Artificial Sequence; identical to SEQ ID NO: 15052
  Synthetic Polypeptide encoding a TCR chain

SEQ ID NO: 15054 - protein, 179 aa, Artificial Sequence
  Synthetic Polypeptide encoding a TCR chain
EDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 15055 - protein, 179 aa, Artificial Sequence
  Synthetic Polypeptide encoding a TCR chain
EDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 15056 - protein, 179 aa, Artificial Sequence; identical to SEQ ID NO: 15052
  Synthetic Polypeptide encoding a TCR chain

SEQ ID NO: 15057 - protein, 179 aa, Artificial Sequence
  Synthetic Polypeptide encoding a TCR chain
EDLKNVFPPEVAVFEPSKAEIAHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 15058 - protein, 179 aa, Artificial Sequence
  Synthetic Polypeptide encoding a TCR chain
EDLKNVFPPEVAVFEPSKAEIAHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 15059 - protein, 179 aa, Artificial Sequence
  Synthetic Polypeptide encoding a TCR chain
EDLKNVFPPEVAVFEPSKAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGITSESYQQGVLSATILYEILLGKATLYAVLVSALVLMAMVKRKDSRG

SEQ ID NO: 15060 - protein, 179 aa, Artificial Sequence
  Synthetic Polypeptide encoding a TCR chain
EDLKNVFPPEVAVFEPSKAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSASYQQGVLSATILYEILLGKATLYAVLVSALVLMAMVKRKDSRG

SEQ ID NO: 15061 - protein, 179 aa, Artificial Sequence
  Synthetic Polypeptide encoding a TCR chain
EDLKNVFPPEVAVFEPSKAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYHQGVLSATILYEILLGKATLYAVLVSALVLMAMVKRKDSRG

SEQ ID NO: 15062 - protein, 179 aa, Artificial Sequence
  Synthetic Polypeptide encoding a TCR chain
EDLKNVFPPEVAVFEPSRAEIAHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 15063 - protein, 179 aa, Artificial Sequence
  Synthetic Polypeptide encoding a TCR chain
EDLKNVFPPEVAVFEPSRAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 15064 - protein, 179 aa, Artificial Sequence
  Synthetic Polypeptide encoding a TCR chain
EDLKNVFPPEVAVFEPSKAEIAHTQKATLVCLATGFYPDHVELSWWVNGKEVHSGVSTDPQPLKEQPALNDSRYCLSSGLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 15065 - protein, 179 aa, Artificial Sequence
  Synthetic Polypeptide encoding a TCR chain
EDLKNVFPPEVAVFEPSKAEIAHTQKATLVCLATGFYPDHVELSWWVNGKEVHSGVSTDPQPLKEQPALNDSRYCLSSGLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 15066 - protein, 179 aa, Artificial Sequence
  Synthetic Polypeptide encoding a TCR chain
EDLKNVFPPEVAVFEPSEAEISHTQKATLVCLATGFYPDHVELSWWVNGKEVHSGVSTDPQPLKEQPALNDSRYCLSSGLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 15067 - protein, 189 aa, Homo sapiens
DKQLDADVSPKPTIFLPSIAETKLQKAGTYLCLLEKFFPDIIKIHWQEKKSNTILGSQEGNTMKTNDTYMKFSWLTVPEESLDKEHRCIVRHENNKNGIDQEIIFPPIKTDVTTVDPKYNYSKDANDVITMDPKDNWSKDANDTLLLQLTNTSAYYMYLLLLLKSVVYFAIITCCLLGRTAFCCNGEKS

SEQ ID NO: 15068 - protein, 173 aa, Homo sapiens
DKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 15069 - protein, 153 aa, Homo sapiens
SQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 15070 - protein, 249 aa, Artificial Sequence; identical to SEQ ID NO: 4559
  Synthetic Polypeptide Encoding a scFv

SEQ ID NO: 15071 - protein, 249 aa, Artificial Sequence; identical to SEQ ID NO: 4559
  Synthetic Polypeptide Encoding a scFv

SEQ ID NO: 15072 - protein, 267 aa, Artificial Sequence; identical to SEQ ID NO: 4562
  Synthetic Polypeptide Encoding a scFv

SEQ ID NO: 15073 - protein, 249 aa, Artificial Sequence; identical to SEQ ID NO: 4563
  Synthetic Polypeptide Encoding a scFv

SEQ ID NO: 15074 - protein, 246 aa, Artificial Sequence; identical to SEQ ID NO: 4564
  Synthetic Polypeptide Encoding a scFv

SEQ ID NO: 15075 - protein, 245 aa, Artificial Sequence; identical to SEQ ID NO: 4565
  Synthetic Polypeptide Encoding a scFv

SEQ ID NO: 15076 - protein, 258 aa, Artificial Sequence; identical to SEQ ID NO: 4566
  Synthetic Polypeptide Encoding a scFv

SEQ ID NO: 15077 - protein, 244 aa, Artificial Sequence; identical to SEQ ID NO: 4567
  Synthetic Polypeptide Encoding a scFv

SEQ ID NO: 15078 - protein, 252 aa, Artificial Sequence; identical to SEQ ID NO: 4568
  Synthetic Polypeptide Encoding a scFv

SEQ ID NO: 15079 - protein, 243 aa, Artificial Sequence; identical to SEQ ID NO: 4569
  Synthetic Polypeptide Encoding a scFv

SEQ ID NO: 15080 - protein, 249 aa, Artificial Sequence; identical to SEQ ID NO: 4570
  Synthetic Polypeptide Encoding a scFv

SEQ ID NO: 15081 - protein, 254 aa, Artificial Sequence; identical to SEQ ID NO: 4571
  Synthetic Polypeptide Encoding a scFv

SEQ ID NO: 15082 - protein, 254 aa, Artificial Sequence; identical to SEQ ID NO: 4581
  Synthetic Polypeptide Encoding a scFv

SEQ ID NO: 15083 - protein, 243 aa, Artificial Sequence; identical to SEQ ID NO: 4582
  Synthetic Polypeptide Encoding a scFv

SEQ ID NO: 15084 - protein, 244 aa, Artificial Sequence; identical to SEQ ID NO: 4583
  Synthetic Polypeptide Encoding a scFv

SEQ ID NO: 15085 - protein, 247 aa, Artificial Sequence; identical to SEQ ID NO: 4591
  Synthetic Polypeptide Encoding a scFv

SEQ ID NO: 15086 - protein, 245 aa, Artificial Sequence; identical to SEQ ID NO: 4592
  Synthetic Polypeptide Encoding a scFv

SEQ ID NO: 15087 - protein, 244 aa, Artificial Sequence; identical to SEQ ID NO: 4593
  Synthetic Polypeptide Encoding a scFv

SEQ ID NO: 15088 - protein, 242 aa, Artificial Sequence; identical to SEQ ID NO: 4594
  Synthetic Polypeptide Encoding a scFv

SEQ ID NO: 15089 - protein, 254 aa, Artificial Sequence; identical to SEQ ID NO: 4595
  Synthetic Polypeptide Encoding a scFv

SEQ ID NO: 15090 - protein, 246 aa, Artificial Sequence; identical to SEQ ID NO: 4596
  Synthetic Polypeptide Encoding a scFv

SEQ ID NO: 15091 - protein, 244 aa, Artificial Sequence; identical to SEQ ID NO: 4593
  Synthetic Polypeptide Encoding a scFv

SEQ ID NO: 15092 - protein, 243 aa, Artificial Sequence; identical to SEQ ID NO: 4598
  Synthetic Polypeptide Encoding a scFv

SEQ ID NO: 15093 - protein, 245 aa, Artificial Sequence; identical to SEQ ID NO: 4599
  Synthetic Polypeptide Encoding a scFv

SEQ ID NO: 15094 - protein, 262 aa, Artificial Sequence; identical to SEQ ID NO: 4600
  Synthetic Polypeptide Encoding a scFv

SEQ ID NO: 15095 - protein, 243 aa, Artificial Sequence; identical to SEQ ID NO: 4601
  Synthetic Polypeptide Encoding a scFv

SEQ ID NO: 15096 - protein, 246 aa, Artificial Sequence; identical to SEQ ID NO: 4604
  Synthetic Polypeptide Encoding a scFv

SEQ ID NO: 15097 - protein, 273 aa, Artificial Sequence; identical to SEQ ID NO: 4610
  Synthetic Polypeptide Encoding a scFv

SEQ ID NO: 15098 - protein, 272 aa, Artificial Sequence; identical to SEQ ID NO: 4611
  Synthetic Polypeptide Encoding a scFv

SEQ ID NO: 15099 - protein, 239 aa, Artificial Sequence; identical to SEQ ID NO: 4612
  Synthetic Polypeptide Encoding a scFv

SEQ ID NO: 15100 - protein, 244 aa, Artificial Sequence; identical to SEQ ID NO: 4613
  Synthetic Polypeptide Encoding a scFv

SEQ ID NO: 15101 - protein, 243 aa, Artificial Sequence; identical to SEQ ID NO: 4614
  Synthetic Polypeptide Encoding a scFv

SEQ ID NO: 15102 - protein, 240 aa, Artificial Sequence; identical to SEQ ID NO: 4615
  Synthetic Polypeptide Encoding a scFv

SEQ ID NO: 15103 - protein, 241 aa, Artificial Sequence; identical to SEQ ID NO: 4620
  Synthetic Polypeptide Encoding a scFv

SEQ ID NO: 15104 - protein, 248 aa, Artificial Sequence; identical to SEQ ID NO: 4623
  Synthetic Polypeptide Encoding a scFv

SEQ ID NO: 15105 - protein, 248 aa, Artificial Sequence; identical to SEQ ID NO: 4624
  Synthetic Polypeptide Encoding a scFv

SEQ ID NO: 15106 - protein, 242 aa, Artificial Sequence; identical to SEQ ID NO: 4625
  Synthetic Polypeptide Encoding a scFv

SEQ ID NO: 15107 - protein, 244 aa, Artificial Sequence; identical to SEQ ID NO: 4626
  Synthetic Polypeptide Encoding a scFv

SEQ ID NO: 15108 - protein, 241 aa, Artificial Sequence; identical to SEQ ID NO: 4627
  Synthetic Polypeptide Encoding a scFv

SEQ ID NO: 15109 - protein, 242 aa, Artificial Sequence; identical to SEQ ID NO: 4628
  Synthetic Polypeptide Encoding a scFv

SEQ ID NO: 15110 - protein, 238 aa, Artificial Sequence; identical to SEQ ID NO: 4629
  Synthetic Polypeptide Encoding a scFv

SEQ ID NO: 15111 - protein, 269 aa, Artificial Sequence; identical to SEQ ID NO: 4630
  Synthetic Polypeptide Encoding a scFv

SEQ ID NO: 15112 - protein, 240 aa, Artificial Sequence; identical to SEQ ID NO: 4631
  Synthetic Polypeptide Encoding a scFv

SEQ ID NO: 15113 - protein, 249 aa, Artificial Sequence; identical to SEQ ID NO: 4632
  Synthetic Polypeptide Encoding a scFv

SEQ ID NO: 15114 - protein, 253 aa, Artificial Sequence; identical to SEQ ID NO: 4633
  Synthetic Polypeptide Encoding a scFv

SEQ ID NO: 15115 - protein, 242 aa, Artificial Sequence; identical to SEQ ID NO: 4648
  Synthetic Polypeptide Encoding a scFv

SEQ ID NO: 15116 - protein, 248 aa, Artificial Sequence; identical to SEQ ID NO: 4649
  Synthetic Polypeptide Encoding a scFv

SEQ ID NO: 15117 - protein, 246 aa, Artificial Sequence; identical to SEQ ID NO: 4650
  Synthetic Polypeptide Encoding a scFv

SEQ ID NO: 15118 - protein, 246 aa, Artificial Sequence; identical to SEQ ID NO: 4651
  Synthetic Polypeptide Encoding a scFv

SEQ ID NO: 15119 - protein, 244 aa, Artificial Sequence; identical to SEQ ID NO: 4656
  Synthetic Polypeptide Encoding a scFv

SEQ ID NO: 15120 - protein, 245 aa, Artificial Sequence; identical to SEQ ID NO: 4657
  Synthetic Polypeptide Encoding a scFv

SEQ ID NO: 15121 - protein, 245 aa, Artificial Sequence; identical to SEQ ID NO: 4658
  Synthetic Polypeptide Encoding a scFv

SEQ ID NO: 15122 - protein, 245 aa, Artificial Sequence; identical to SEQ ID NO: 4659
  Synthetic Polypeptide Encoding a scFv

SEQ ID NO: 15123 - protein, 243 aa, Artificial Sequence; identical to SEQ ID NO: 4660
  Synthetic Polypeptide Encoding a scFv

SEQ ID NO: 15124 - protein, 243 aa, Artificial Sequence; identical to SEQ ID NO: 4661
  Synthetic Polypeptide Encoding a scFv

SEQ ID NO: 15125 - protein, 255 aa, Artificial Sequence; identical to SEQ ID NO: 4674
  Synthetic Polypeptide Encoding a scFv

SEQ ID NO: 15126 - protein, 251 aa, Artificial Sequence; identical to SEQ ID NO: 4675
  Synthetic Polypeptide Encoding a scFv

SEQ ID NO: 15127 - protein, 242 aa, Artificial Sequence; identical to SEQ ID NO: 4688
  Synthetic Polypeptide Encoding a scFv

SEQ ID NO: 15128 - protein, 244 aa, Artificial Sequence; identical to SEQ ID NO: 4689
  Synthetic Polypeptide Encoding a scFv

SEQ ID NO: 15129 - protein, 246 aa, Artificial Sequence; identical to SEQ ID NO: 4700
  Synthetic Polypeptide Encoding a scFv

SEQ ID NO: 15130 - protein, 250 aa, Artificial Sequence; identical to SEQ ID NO: 4702
  Synthetic Polypeptide Encoding a scFv

SEQ ID NO: 15131 - protein, 247 aa, Artificial Sequence; identical to SEQ ID NO: 4703
  Synthetic Polypeptide Encoding a scFv

SEQ ID NO: 15132 - protein, 240 aa, Artificial Sequence; identical to SEQ ID NO: 4759
  Synthetic Polypeptide Encoding a scFv

SEQ ID NO: 15133 - protein, 60 aa, Artificial Sequence
  Synthetic Polypeptide Encoding a scFv
IPEDTFFPSPESSCDVKLVEKSFETDTNLNFQNLSVIGFRILLLKVAGFNLLMTLRLWSS

SEQ ID NO: 15134 - protein, 53 aa, Artificial Sequence
  Synthetic Polypeptide Encoding a scFv
GRADCGFTSESYQQGVLSATILYEILLGKATLYAVLVSALVLMAMVKRKDSRG

SEQ ID NO: 15135 - protein, 67 aa, Artificial Sequence
  Synthetic Polypeptide Encoding a scFv
PIKTDVITMDPKDNCSKDANDTLLLQLTNTSAYYMYLLLLLKSVVYFAIITCCLLRRTAFCCNGEKS

SEQ ID NO: 15136 - protein, 68 aa, Artificial Sequence
  Synthetic Polypeptide Encoding a scFv
EVKTDSTDHVKPKETENTKQPSKSCHKPKAIVHTEKVNMMSLTVLGLRMLFAKTVAVNFLLTAKLFFL

SEQ ID NO: 15137 - protein, 79 aa, Artificial Sequence
  Synthetic Polypeptide Encoding a scFv
MDWIWRILFLVGAATGAHSIPEDTFFPSPESSCDVKLVEKSFETDTNLNFQNLSVIGFRILLLKVAGFNLLMTLRLWSS

SEQ ID NO: 15138 - protein, 72 aa, Artificial Sequence
  Synthetic Polypeptide Encoding a scFv
MDWIWRILFLVGAATGAHSGRADCGFTSESYQQGVLSATILYEILLGKATLYAVLVSALVLMAMVKRKDSRG

SEQ ID NO: 15139 - protein, 86 aa, Artificial Sequence
  Synthetic Polypeptide Encoding a scFv
MDWIWRILFLVGAATGAHSPIKTDVITMDPKDNCSKDANDTLLLQLTNTSAYYMYLLLLLKSVVYFAIITCCLLRRTAFCCNGEKS

SEQ ID NO: 15140 - protein, 87 aa, Artificial Sequence
  Synthetic Polypeptide Encoding a scFv
MDWIWRILFLVGAATGAHSEVKTDSTDHVKPKETENTKQPSKSCHKPKAIVHTEKVNMMSLTVLGLRMLFAKTVAVNFLLTAKLFFL

SEQ ID NO: 15141 - DNA, 180 bp, Artificial Sequence
  Synthetic Polynucleotide Encoding a Partial TCR Chain
atccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 15142 - DNA, 159 bp, Artificial Sequence
  Synthetic Polynucleotide Encoding a Partial TCR Chain
ggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 15143 - DNA, 201 bp, Artificial Sequence
  Synthetic Polynucleotide Encoding a Partial TCR Chain
cccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtct

SEQ ID NO: 15144 - DNA, 204 bp, Artificial Sequence
  Synthetic Polynucleotide Encoding a Partial TCR Chain
gaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 15145 - DNA, 237 bp, Artificial Sequence
  Synthetic Polynucleotide Encoding a Partial TCR Chain
atggattggatatggaggatactttttctcgtgggggcagcaaccggggctcattccatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 15146 - DNA, 216 bp, Artificial Sequence
  Synthetic Polynucleotide Encoding a Partial TCR Chain
atggattggatatggaggatactttttctcgtgggggcagcaaccggggctcattccggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 15147 - DNA, 258 bp, Artificial Sequence
  Synthetic Polynucleotide Encoding a Partial TCR Chain
atggattggatatggaggatactttttctcgtgggggcagcaaccggggctcattcccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtct

SEQ ID NO: 15148 - DNA, 261 bp, Artificial Sequence
  Synthetic Polynucleotide Encoding a Partial TCR Chain
atggattggatatggaggatactttttctcgtgggggcagcaaccggggctcattccgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 15149 - protein, 8 aa, Artificial Sequence
  Synthetic  Peptide Encoding an Epitope
PAGIYAPI

SEQ ID NO: 15150 - protein, 15 aa, Artificial Sequence
  Synthetic  Peptide Encoding an Epitope
FLKMESLNFIRAHTP

SEQ ID NO: 15151 - protein, 17 aa, Artificial Sequence
  Synthetic  Peptide Encoding an Epitope
HFLKMESLNFIRAHTPY

SEQ ID NO: 15152 - protein, 18 aa, Artificial Sequence
  Synthetic  Peptide Encoding an Epitope
YNAEPANPSEKNSPSTQY

SEQ ID NO: 15153 - protein, 16 aa, Artificial Sequence
  Synthetic  Peptide Encoding an Epitope
YNAEPANPSEKNSPST

SEQ ID NO: 15154 - protein, 14 aa, Artificial Sequence
  Synthetic  Peptide Encoding an Epitope
YNCEPANPSEKNSP

SEQ ID NO: 15155 - protein, 22 aa, Artificial Sequence
  Synthetic  Peptide Encoding an Epitope
EYFDSLLHACIPCQLRCSSNTP

SEQ ID NO: 15156 - protein, 34 aa, Artificial Sequence
  Synthetic  Peptide Encoding an Epitope
CSQNEYFDSLLHACIPCQLRCSSNTPPLTCQRYC

SEQ ID NO: 15157 - protein, 41 aa, Artificial Sequence
  Synthetic  Peptide Encoding an Epitope
MLQMAGQCSQNEYFDSLLHACIPCQLRCSSNTPPLTCQRYC

SEQ ID NO: 15158 - protein, 51 aa, Artificial Sequence
  Synthetic  Peptide Encoding an Epitope
MLQMAGQCSQNEYFDSLLHACIPCQLRCSSNTPPLTCQRYCNASVTNSVKG

SEQ ID NO: 15159 - protein, 31 aa, Artificial Sequence
  Synthetic  Peptide Encoding an Epitope
TNAILWTCLGLSLIISLAVFVLMFLLRKINS

SEQ ID NO: 15160 - protein, 7 aa, Artificial Sequence
  Synthetic  Peptide Encoding an Epitope
PWQDGPK
